(12) United States Patent
Flint et al.

(10) Patent No.: US 9,297,016 B2
(45) Date of Patent: Mar. 29, 2016

(54) ACTIVITY OF FE—S CLUSTER REQUIRING PROTEINS

(75) Inventors: Dennis Flint, Newark, DE (US); Brian James Paul, Wilmington, DE (US); Rick W. Ye, Hockessin, DE (US)

(73) Assignee: Butamax Advanced Biofuels LLC, Wilmington, DE (US)

( * ) Notice: Subject to any disclaimer, the term of this patent is extended or adjusted under 35 U.S.C. 154(b) by 671 days.

(21) Appl. No.: 13/029,558

(22) Filed: Feb. 17, 2011

(65) Prior Publication Data

US 2012/0064561 A1  Mar. 15, 2012

Related U.S. Application Data

(60) Provisional application No. 61/305,333, filed on Feb. 17, 2010.

(51) Int. Cl.

| | | |
|---|---|---|
| C12N 15/81 | (2006.01) | |
| C07K 14/395 | (2006.01) | |
| C12N 9/88 | (2006.01) | |
| C12P 7/16 | (2006.01) | |
| C12P 7/40 | (2006.01) | |
| C12P 13/02 | (2006.01) | |
| C12P 13/04 | (2006.01) | |
| C12Q 1/527 | (2006.01) | |
| G01N 33/573 | (2006.01) | |

(52) U.S. Cl.
CPC .............. *C12N 15/81* (2013.01); *C07K 14/395* (2013.01); *C12N 9/88* (2013.01); *C12P 7/16* (2013.01); *C12P 7/40* (2013.01); *C12P 13/02* (2013.01); *C12P 13/04* (2013.01); *C12Q 1/527* (2013.01); *C12Y 402/01009* (2013.01); *G01N 33/573* (2013.01); *Y02E 50/10* (2013.01); *Y02P 20/52* (2015.11)

(58) Field of Classification Search
CPC ........... C12N 15/81; C12N 9/88; Y02E 50/10
See application file for complete search history.

(56) References Cited

U.S. PATENT DOCUMENTS

| | | |
|---|---|---|
| 4,683,202 A | 7/1987 | Mullis |
| 5,643,779 A | 7/1997 | Ehrlich et al. |

(Continued)

FOREIGN PATENT DOCUMENTS

| | | |
|---|---|---|
| CA | 2716427 | 8/2009 |
| EP | 1887081 | 2/2008 |

(Continued)

OTHER PUBLICATIONS

Guo et al., Protein tolerance to random amino acid change, 2004, Proc. Natl. Acad. Sci. USA 101: 9205-9210.*

(Continued)

*Primary Examiner* — Alexander Kim

(57) ABSTRACT

The present invention is related to a recombinant host cell, in particular a yeast cell, comprising a dihydroxy-acid dehydratase polypeptide. The invention is also related to a recombinant host cell having increased specific activity of the dihydroxy-acid dehydratase polypeptide as a result of increased expression of the polypeptide, modulation of the Fe—S cluster biosynthesis of the cell, or a combination thereof. The present invention also includes methods of using the host cells, as well as, methods for identifying polypeptides that increase the flux in an Fe—S cluster biosynthesis pathway in a host cell.

13 Claims, 11 Drawing Sheets

(56) References Cited

U.S. PATENT DOCUMENTS

| | | |
|---|---|---|
| 6,177,264 B1 | 1/2001 | Eggeling et al. |
| 6,699,703 B1 | 3/2004 | Doucette-Stamm et al. |
| 7,541,173 B2 | 6/2009 | Bramucci et al. |
| 7,659,104 B2 | 2/2010 | Bramucci et al. |
| 7,851,188 B2 | 12/2010 | Donaldson et al. |
| 7,910,342 B2 | 3/2011 | Liao et al. |
| 7,932,063 B2 | 4/2011 | Dunson et al. |
| 7,993,889 B1 | 8/2011 | Donaldson et al. |
| 8,017,364 B2 | 9/2011 | Bramucci et al. |
| 8,017,376 B2 | 9/2011 | Dundon et al. |
| 8,071,358 B1 | 12/2011 | Dundon et al. |
| 8,129,162 B2 | 3/2012 | Li et al. |
| 8,178,328 B2 | 5/2012 | Donaldson et al. |
| 8,188,250 B2 | 5/2012 | Bramucci et al. |
| 8,206,970 B2 | 6/2012 | Eliot et al. |
| 8,222,017 B2 | 7/2012 | Li et al. |
| 8,232,089 B2 | 7/2012 | Urano et al. |
| 8,241,878 B2 | 8/2012 | Anthony et al. |
| 8,273,558 B2 | 9/2012 | Donaldson et al. |
| 8,273,565 B2 | 9/2012 | Dundon et al. |
| 8,283,144 B2 | 10/2012 | Donaldson et al. |
| 8,372,612 B2 | 2/2013 | Larossa et al. |
| 8,389,252 B2 | 3/2013 | Larossa |
| 8,455,224 B2 | 6/2013 | Paul |
| 8,455,225 B2 | 6/2013 | Bramucci et al. |
| 8,465,964 B2 | 6/2013 | Anthony et al. |
| 8,518,678 B2 | 8/2013 | Flint et al. |
| 8,557,562 B2 | 10/2013 | Bramucci et al. |
| 8,614,085 B2 | 12/2013 | Van Dyk et al. |
| 8,617,861 B2 | 12/2013 | Grady et al. |
| 8,637,281 B2 | 1/2014 | Paul et al. |
| 8,637,289 B2 | 1/2014 | Anthony et al. |
| 8,652,823 B2 | 2/2014 | Flint et al. |
| 8,669,094 B2 | 3/2014 | Anthony et al. |
| 8,691,540 B2 | 4/2014 | Bramucci et al. |
| 8,735,114 B2 | 5/2014 | Donaldson et al. |
| 8,765,433 B2 | 7/2014 | Gude et al. |
| 8,785,166 B2 | 7/2014 | Anthony et al. |
| 8,795,992 B2 | 8/2014 | Bramucci et al. |
| 8,828,694 B2 | 9/2014 | Anthony et al. |
| 8,828,695 B2 | 9/2014 | Grady et al. |
| 8,828,704 B2 | 9/2014 | Donaldson et al. |
| 8,871,488 B2 | 10/2014 | Dauner et al. |
| 8,889,385 B2 | 11/2014 | Donaldson et al. |
| 8,895,307 B2 | 11/2014 | Li et al. |
| 8,906,666 B2 | 12/2014 | Alsaker et al. |
| 8,911,981 B2 | 12/2014 | Li et al. |
| 8,940,511 B2 | 1/2015 | Larossa |
| 8,945,859 B2 | 2/2015 | Donaldson et al. |
| 8,945,899 B2 | 2/2015 | Li et al. |
| 8,951,774 B2 | 2/2015 | Donaldson et al. |
| 8,951,937 B2 | 2/2015 | Flint et al. |
| 8,956,850 B2 | 2/2015 | Anthony et al. |
| 8,962,298 B2 | 2/2015 | Donaldson et al. |
| 8,969,055 B2 | 3/2015 | Grady et al. |
| 8,969,065 B2 | 3/2015 | Anthony et al. |
| 8,980,612 B2 | 3/2015 | Donaldson et al. |
| 2003/0166179 A1 | 9/2003 | Rajgarhia et al. |
| 2007/0031918 A1 | 2/2007 | Dunson et al. |
| 2007/0092957 A1* | 4/2007 | Donaldson et al. ............ 435/157 |
| 2008/0182308 A1 | 7/2008 | Donaldson et al. |
| 2008/0293125 A1 | 11/2008 | Subbian et al. |
| 2009/0081746 A1 | 3/2009 | Liao et al. |
| 2009/0163082 A1 | 6/2009 | Li et al. |
| 2009/0269823 A1 | 10/2009 | Bramucci et al. |
| 2009/0305363 A1 | 12/2009 | Anthony |
| 2010/0081154 A1 | 4/2010 | Flint et al. |
| 2010/0081179 A1 | 4/2010 | Anthony et al. |
| 2010/0081182 A1 | 4/2010 | Paul |
| 2010/0093020 A1 | 4/2010 | Bramucci et al. |
| 2010/0120105 A1 | 5/2010 | Anthony et al. |
| 2010/0129886 A1 | 5/2010 | Anthony et al. |
| 2010/0129887 A1 | 5/2010 | Anthony |
| 2010/0197519 A1 | 8/2010 | Li et al. |
| 2010/0221802 A1 | 9/2010 | Grady et al. |
| 2011/0039327 A1 | 2/2011 | Winkler et al. |
| 2011/0076733 A1 | 3/2011 | Urano et al. |
| 2011/0124060 A1 | 5/2011 | Anthony et al. |
| 2011/0136192 A1 | 6/2011 | Paul et al. |
| 2011/0136193 A1 | 6/2011 | Grady et al. |
| 2011/0195505 A1 | 8/2011 | Euler et al. |
| 2011/0244536 A1 | 10/2011 | Nagarajan et al. |
| 2011/0250610 A1 | 10/2011 | Bramucci et al. |
| 2011/0287500 A1 | 11/2011 | Urano et al. |
| 2011/0294179 A1 | 12/2011 | Grady et al. |
| 2012/0034666 A1 | 2/2012 | Hawkins et al. |
| 2012/0058541 A1 | 3/2012 | Alsaker et al. |
| 2012/0149080 A1 | 6/2012 | Bramucci et al. |
| 2012/0196341 A1 | 8/2012 | Donaldson et al. |
| 2012/0237988 A1 | 9/2012 | Anthony et al. |
| 2012/0258873 A1 | 10/2012 | Gibson et al. |
| 2013/0035515 A1 | 2/2013 | Dobson et al. |
| 2013/0071898 A1 | 3/2013 | Anthony et al. |
| 2013/0171706 A1 | 7/2013 | Donaldson et al. |
| 2013/0203138 A1 | 8/2013 | McElvain et al. |
| 2013/0252296 A1 | 9/2013 | Maggio-Hall et al. |
| 2013/0316414 A1 | 11/2013 | Paul et al. |
| 2014/0004526 A1 | 1/2014 | Dauner et al. |
| 2014/0030782 A1 | 1/2014 | Anthony et al. |
| 2014/0030783 A1 | 1/2014 | Anthony et al. |
| 2014/0038263 A1 | 2/2014 | Flint et al. |
| 2014/0038268 A1 | 2/2014 | Flint et al. |
| 2014/0051133 A1 | 2/2014 | Govindarajan et al. |
| 2014/0051137 A1 | 2/2014 | Flint et al. |
| 2014/0057329 A1 | 2/2014 | Li et al. |
| 2014/0093930 A1 | 4/2014 | Li et al. |
| 2014/0096439 A1 | 4/2014 | Bramucci, et al. |
| 2014/0141479 A1 | 5/2014 | Anthony et al. |
| 2014/0170732 A1 | 6/2014 | Bramucci, et al. |
| 2014/0186910 A1 | 7/2014 | Rothman et al. |
| 2014/0186911 A1 | 7/2014 | Anthony et al. |
| 2014/0273116 A1 | 9/2014 | Kelly et al. |
| 2014/0273129 A1 | 9/2014 | Bhalla et al. |
| 2014/0308735 A1 | 10/2014 | Anthony et al. |
| 2014/0335582 A1 | 11/2014 | Donaldson et al. |
| 2014/0349349 A1 | 11/2014 | Dauner et al. |
| 2014/0377824 A1 | 12/2014 | Satagopan et al. |
| 2015/0037855 A1 | 2/2015 | Bhadra et al. |
| 2015/0111269 A1 | 4/2015 | Li et al. |
| 2015/0119608 A1 | 4/2015 | Donaldson et al. |
| 2015/0125920 A1 | 5/2015 | Anthony et al. |

FOREIGN PATENT DOCUMENTS

| | | | |
|---|---|---|---|
| WO | WO2006059111 | | 6/2006 |
| WO | 2007020992 | | 2/2007 |
| WO | WO 2007/050671 | * | 5/2007 |
| WO | WO2007106524 | | 9/2007 |
| WO | WO2008098227 | | 8/2008 |
| WO | WO2009086423 | | 7/2009 |
| WO | WO2009/149270 | * | 12/2009 |
| WO | 2011019894 A1 | | 2/2011 |
| WO | 2011066356 A1 | | 6/2011 |

OTHER PUBLICATIONS

Lazar et al., Transforming Growth Factor α: Mutation of Aspartic Acid 47 and Leucine 48 Results in Different Biological Activity, 1988, Mol. Cell. Biol. 8:1247-1252.*

Hill et al., Functional Analysis of conserved Histidines in ADP-Glucose Pyrophosphorylase from *Escherichia coli*, 1998, Biochem. Biophys. Res. Comm. 244:573-577.*

Wacey et al., Disentangling the perturbational effects of amino acid substitutions in the DNA-binding domain of p53., Hum Genet, 1999, vol. 104, pp. 15-22.*

Flint et al., The role and properties of the iron—sulfur cluster in *Escherichia coli* dihydroxy-acid dehydratase., The Journal of Biological Chemistry (1993-B), vol. 268, pp. 14732-14742.*

Velasco et al. "Cloning of a dihydroxyacid dehydratase-encoding gene (1LV3) from *Saccharomyces cerevisiae*", Gene, 1993, vol. 137, No. 2, pp. 179-1985.

(56) References Cited

OTHER PUBLICATIONS

Goldberg et al., "Localization and functionality of microsporidian iron—sulphur cluster assembly proteins", Nature, 2008, vol. 452, No. 3, pp. 624-628.
Casey et al., Cloning and analysis of two alleles of the 1LV3 gene from *Saccharomyces carlsbergensis*, Carlsberg Res. Commun., 1986, vol. 51, pp. 327-341.
Flint et al., Studies on the synthesis of the Fe—S cluster of dihydroxy-acid dehydratase in *Escherichia coli* crude extract, The Journal of Biological Chemistry, 1996, vol. 271, No. 27, pp. 16053-16067.
International Search Report and Written Opinion of corresponding PCT/US2011/025258 mailed Feb. 27, 2012.
Altschul et al., "Basic Local Alignment Search Tool", J. Mol. Biol., 1990, vol. 215, pp. 403-410.
Bandyopadhyay et al., "A Proposed Role for the *Azotobacter vinelandii* NfuA Protein as an Intermediate Iron—Sulfur Cluster Carrier", The Journal of Biological Chemistry, May 16, 2008, vol. 283, No. 20, pp. 14092-14099.
Deshpande, "Ethanol Production from Cellulose by Coupled Saccharification/Fermentation using *Saccharomyces cerevisiae* and Cellulase Complex from *Sclerotium rolfsii* UV-8 Mutant", Applied Biochemistry and Biotechnology, 1992, vol. 36, pp. 227-234.
Durre, "New insights and novel developments in clostridial acetone/butanol/isopropanol fermentation", Appl. Microbiol. Biotechnol. (1998) vol. 49, pp. 639-648.
Flint et al., "Dihydroxy Acid Dehydratase from Spinach Contains a [2Fe—2S] Cluster", The Journal of Biological Chemistry, Mar. 15, 1988, vol. 263, No. 8, pp. 3558-3564.
Foury et al., "Mitochondrial Control of Iron Homeostasis", The Journal of Biological Chemistry, Mar. 16, 2001, vol. 276, No. 11, pp. 7762-7768.
Gerber et al., "The Yeast Scaffold Proteins Isu1p and Isu2p Are Required Inside Mitochondria for Maturation of Cytosolic Fe/S Proteins", Molecular and Cellular Biology, Jun. 2004, vol. 24, No. 11, pp. 4848-4857.
Groot et al., "Technologies for Butanol Recovery Integrated with Fermentations", Process Chemistry, 1992, vol. 27, pp. 61-75.
Guo et al., "Pervaporation study on the dehydration of aqueous butanol solutions: a comparison of flux vs. permeance, separation factor vs. selectivity", Journal of Membrane Science 245, 2004, pp. 199-210.
Gupta et al., "Native *Escherichia coli* SufA, Coexpressed with SufBCDSE, Purifies as a [2Fe—S5] Protein and Acts as an Fe—S Transporter to Fe—S Target Enzymes", Journal of American Chemical Society, 2009, vol. 131, pp. 6149-6153.
Higgins et al., "CLUSTAL V: improved software for multiple sequence alignment", CABIOS, 1992, vol. 8, No. 2 pp. 189-191.
Higgins et al., "Fast and sensitive multiple sequence alignments on a microcomputer", CABIOS Communications, 1989, vol. 5, No. 2 pp. 151-153.
Johnson et al., "Structure, Function, and Formation of Biological Iron—Sulfur Clusters", Annual Reviews Biochemistry, 2005, vol. 74, pp. 247-281.
Kaplan et al., "Iron Acquisition and Transcriptional Regulation", Chemical Reviews, 2009, vol. 109, pp. 4536-4552.
Kim et al., "Transposable Elements and Genome Organization: A Comprehensive Survey of Retrotransposons Revealed by the Complete *Saccharomyces cervisiae* Genome?Sequence", Genome Research, 1998, vol. 8, pp. 464-478.
Krogh et al., "Hidden Markov Models in Computational Biology—Applications to Protein Modeling", Journal Molecular Biology, 1994, vol. 235, pp. 1501-1531.
Kumanovics et al., "Identification of FRA1 and FRA2 as Genes Involved in Regulating the Yeast Iron Regulon in Response to Decreased Mitochondrial Iron—Sulfur Cluster Synthesis", The Journal of Biological Chemistry, Apr. 18, 2008, vol. 283, No. 16, pp. 10276-10286.

Li, H. et al., "The Yeast Iron Regulatory Proteins Grx3/4 and Fra2 Form Heterodimeric Complexes Containing a [2Fe—2S] Cluster with Cysteinyl and Histidyl Ligation", Biochemistry, 2009, vol. 48, pp. 9569-9581.
Li, L. et al., "CCC1 Is a Transporter That Mediates Vacuolar Iron Storage in Yeast", The Journal of Biological Chemistry, Aug. 3, 2001, vol. 276, No. 31, pp. 29515-29519.
Liu, Y. et al., "Iron—Sulfur Cluster Biosynthesis: Functional Characterization of the N- and C-Terminal Domains of Human NFU", Biochemistry, 2009, vol. 48, pp. 973-980.
Nakamura et al., "Codon usage tabulated from international DNA sequence databases: status for the year 2000", Nucleic Acids Research, 2000, vol. 28, No., p. 292.
Ojeda et al., "Role of Glutaredoxin-3 and Glutaredoxin-4 in the Iron Regulation of the Aft1 Transcriptional Activator in *Saccharomyces cervisiae*", The Journal of Biological Chemistry, Jun. 30, 2006, vol. 281, No. 26, pp. 17661-17669.
Pujol-Carrion et al., "Glutaredoxins Grx3 and Grx4 regulate nuclear localisation of Aft1 and the oxidative stress response in *Saccharomyces cerevisiae*", Journal of Cell Science, 2006, vol. 19, pp. 4554-4564.
Rutherford et al., "Activation of the Iron Regulon by the Yeast Aft1/Aft2 Transcription Factors Depends on Mitochondrial but Not Cytosolic Iron—Sulfur Protein Biogenesis", The Journal of Biological Chemistry, Mar. 18, 2005, vol. 280, No. 11, pp. 10135-10140.
Shakoury-Elizeh et al., "Transcriptional Remodeling in Response to Iron Deprivation in *Saccharomyces cerevisiae*", Molecular Biology of the Cell, Mar. 2004, vol. 15, pp. 1233-1243.
Sulter et al., "Proliferation and metabolic significance of peroxisomes in *Candida boidinii* during growth on D-alanine or oleic acid as the sole carbon source", Archives of Microbiology, 1990, vol. 153, pp. 485-489.
Ueta et al., "Pse1p Mediates the Nuclear Import of the Iron-responsive Transcription Factor Aft1p in *Saccharomyces cerevisiae*", The Journal of Biological Chemistry, Dec. 12, 2003, vol. 278, No. 50, pp. 50120-50127.
Yamaguchi-Iwai et al., "Subcellular Localization of Aft1 Transcription Factor Responds to Iron Status in *Saccharomyces cerevisiae*", The Journal of Biological Chemistry, May 24, 2002, vol. 277, No. 21, pp. 18914-18918.
Yamaguchi-Iwai et al., "AFT1: a mediator of iron regulated transcriptional control in *Saccharomyces cerevisiae*", The EMBO Journal, 1995, vol. 14, No. 6, pp. 1231-1239.
Aden et al. Lignocellulosic Biomass to Ethanol Process Design and Economics Utilizing Co-Current Dilute Acid Prehydrolysis and Enzymatic Hydrolysis for Corn Stover, Report NREL/TP-510-32438, National Renewable Energy Laboratory, Jun. 2002.
Bellion et al., Microb. Growth C1 Compd., [Int. Symp.], 7th (1993), 415 32, Editor(s): Murrell, J. Collin; Kelly, Don P. Publisher: Intercept, Andover, UK.
Tan et al., "IscA/SufA paralogues are required for the [4Fe—4S] cluster assembly in enzymes of multiple physiological pathways in *Escherichia coli* under aerobic growth conditions", Biochem. Journal, 2009, vol. 420, pp. 463-472.
Methods in Yeast Genetics, 2005, Cold Spring Harbor Laboratory Press, Cold Spring Harbor, NY, pp. 201-202.
Pearson, Comput. Methods Genome Res., [Proc. Int. Symp.] (1994), Meeting Date 1992, 111 20. Editor(s): Suhai, Sandor. Plenum: New York, NY.
Sambrook, J., Fritsch, E. F. and Maniatis, T. Molecular Cloning: A Laboratory Manual, 2nd ed., Cold Spring Harbor Laboratory: Cold Spring Harbor, NY (1989), particularly 9.50-9.51, 11.7-11.8 and Table 11.1.
Ausubel, F. M. et al., Current Protocols in Molecular Biology, published by Greene Publishing Assoc. and Wiley Interscience (1987).
U.S. Appl. No. 12/893,077, filed Sep. 29, 2010.
U.S. Appl. No. 12/980,597, filed Dec. 29, 2010.
U.S. Appl. No. 13/161,168, filed Jun. 15, 2011.
U.S. Appl. No. 13/227,016, filed Sep. 7, 2011.
Lill et al., "Maturation of Iron—Sulfur Proteins in Eukaryotes: Mechanisms, Connected Processes, and Diseases", Annual Reviews Biochemistry, 2008, vol. 77, pp. 669-700.

(56) References Cited

OTHER PUBLICATIONS

"Dihydroxy-Acid Dehydratase" in *Springer Handbook of Enzymes*, vol. 4, Class 4, Lyases II, 2nd Ed., Schomburg, D., et al., Eds., pp. 296-303, Springer-Verlag, Germany (2002).

Askwith, C., et al., "The *FET3* Gene of *S. cerevisiae* Encodes a Multicopper Oxidase Required for Ferrous Iron Uptake," *Cell* 76:403-410, Cell Press, United States (1994).

Armstrong, F.B., et al., "Stereoselectivity and Stereospecificity of the α,β-Dihydroxy Acid Dehydratase from *Salmonella typhimurium*," *Biochimica et Biophysica Acta* 498:282-293, Elsevier/North-Holland Biomedical Press, Netherlands (1977).

Armstrong, F.B., "Stereochemistry of the Reductoisomerase and αβ-Dihydroxyacid Dehydratase-catalysed Steps in Valine and Isoleucine Biosynthesis. Observation of a Novel Tertiary Ketol Rearrangement," *J.C.S. Chem. Comm.* 9:351-352, Royal Society of Chemistry, England (1974).

Armstrong, F.B, et al., "Structure-Activity Studies with the αβ-Dihydroxyacid Dehydratase of *Salmonella typhimurium*," *J. Chem. Soc. Perkin Trans. 1*:691-696, Royal Society of Chemistry, England (1985).

Atsumi. S. and Liao, J.C., "Metabolic engineering for advanced biofuels production from *Escherichia coli*," *Current Opinion in Biotechnology* 19:414-419, Elsevier Ltd., England (2008).

Casas, C., et al., "The *AFT1* Transcriptional Factor is Differentially Required for Expression of High-Affinity Iron Uptake Genes in *Saccharomyces cerevisiae*," *Yeast* 13:621-637, John Wiley & Sons Ltd, England (1997).

Chen, S., et al., "Role of NifS in Maturation of Glutamine Phosphoribosylpyrophosphate Amidotransferase," *Journal of Bacteriology* 179(23):7587-7590, American Society of Microbiology, United States (1997).

Coleman, M.S. and Armstrong, F.B., "Branched-chain Amino-acid Aminotransferase of *Salmonella typhimurium*: I. Crystallization and Preliminary Characterization," *Biochimica et Biophysica Acta* 227:56-66, Elsevier/North-Holland Biomedical Press, Netherlands (1971).

Conde E Silva, N., et al., "K1Aft, the *Kluyveromyces lactis* Ortholog of Aft1 and Aft2, Mediates Activation of Iron-Responsive Transcription Through the PuCACCC Aft-Type Sequence," *Genetics* 183:93-106, Genetics Society of America, United States (2009).

Flint, D.H., "*Escherichia coli* Contains a Protein That Is Homologous in Function and N-terminal Sequence to the Protein Encoded by the *nifS* Gene of *Azotobacter vinelandii* and That Can Participate in the Synthesis of the Fe—S Cluster of Dihydroxy-acid Dehydratase," *The Journal of Biological Chemistry* 271(27):16068-16074, The American Society for Biochemistry and Molecular Biology, Inc., United States (1996).

Flint et al., "The Inactivation of Dihydroxy-acid Dehydratase in *Esherichia coli* Treated with Hyperbaric Oxygen Occurs Beacuse of the Destruction of Its Fe—S Cluster, but the Enzyme Remains in the Cell in a Form That Can Be Reactivated," *Journal of Biological Chemistry* 268(34):25547-25552, The American Society for Biochemistry and Molecular Biology, Inc., United States (1993).

Hausmann, A., et al., "The eukaryotic P loop NTPase Nbp35: An essential component of the cytosolic and nuclear iron—sulfur protein assembly machinery," *Proc. Natl. Acad. Sci.* 102(9):3266-3271, National Academy of Sciences, United States (2005).

Henriksen, C.M. and Nilsson, D., "Redirection of pyruvate catabolism in *Lactococcus lactis* by selection of mutants with additional growth requirements," *Appl Microbiol Biotechnol* 56:767-775, Springer-Verlag, Germany (2001).

Holátko, J., et al., "Metabolic engineering of the L-valine biosynthesis pathway in *Corynebacterium glutamicum* using promoter activity modulation," *Journal of Biotechnology* 139:203-210, Elsevier B.V., Netherlands (2009).

Ihrig, J., et al., "Iron Regulation through the Back Door: Iron-Dependent Metabolite Levels Contribute to Transcriptional Adaptation to Iron Deprivation in *Saccharomyces cerevisiae*," *Eukaryotic Cell* 9(3):460-471, American Society for Microbiology, United States (2010).

Mercier, A. and Labbé, S., "Both Php4 Function and Subcellular Localization Are Regulated by Iron via a Multistep Mechanism Involving the Gluaredoxin Grx4 and the Exportin Crm1," *Journal of Biological Chemistry* 284(30):20249-20262, The American Society for Biochemistry and Molecular Biology, Inc., United States (2009).

Mühlenhoff, U., et al., "Cytosolic Monothiol Glutaredoxins Function in Intracellular Iron Sensing and Trafficking via Their Bound Iron—Sulfur Cluster," *Cell Metabolism* 12:373-385, Elsevier Inc., United States (2010).

Ojeda, L.D., "Iron Sensing in the Model Organism *Saccharomyces cerevisiae*," A dissertation submitted to the faculty of the University of Utah in partial fulfillment of the requirements for the degree of Doctor of Philosophy, The University of Utah, United States (2006).

Puig, S., et al., "Coordinated Remodeling of Cellular Metabolism during Iron Deficiency through Targeted mRNA Degradation," *Cell* 120:99-110, Elsevier Inc., United States (2005).

Ruhterford, J.C., et al., "A second iron-regulatory system in yeast independent of Aft1p," *PNAS* 98(25):14322-14327, National Academy of Sciences, United States (2001).

Rutherford, J.C., et al., "Aft1p and Aft2p Mediate Iron-responsive Gene Expression in Yeast through Related Promoter Elements," *Journal of Biological Chemistry* 278(30):27636-27643, The American Society for Biochemistry and Molecular Biology, Inc., United States (2003).

Seguin, A., et al., "Overexpression of the yeast frataxin homolog (Yfh1): Contrasting effects on iron—sulfur cluster assembly, heme synthesis and resistance to oxidative stress," *Mitochondrion* 9:130-138, Elsevier B.V. and Mitochondrion Research Society, Netherlands (2010).

Stemmler, T.L., et al., "Frataxin and Mitochondrial FeS Cluster Biogenesis," *Journal of Biological Chemistry* 285(35):26737-26743, The American Society for Biochemistry and Molecular Biology, Inc., United States (2010).

Twarog, R., "Enzymes of the Isoleucine-Valine Pathway in *Acinetobacter*," *Journal of Bacteriology* 111(1):37-46, American Society for Microbiology, United States (1972).

Ui, S., et al., "Production of $_L$-2,3-butanediol by a new pathway constructed in *Escherichia coli*," *Letters in Applied Microbiology* 39:533-537, The Society for Applied Microbiology, England (2004).

Wixom, R.L., et al., "A Rapid Determination of Dihydroxyacid Dehydratase Activity in Microbial Cell Suspensions," *Analytical Biochemistry* 42:262-274, Academic Press, United States (1971).

Xing, R. and Whitman, W.B., "Characterization of Enzymes of the Branched-Chain Amino Acid Biosynthetic Pathway in *Methanococcus* spp.," *Journal of Bacteriology* 173(6):2086-2092, American Society for Microbiology, United States (1991).

Re-examination of U.S. Pat. No. 8,017,376, U.S. Control No. 95/001,870, filed Jan. 10, 2012.

Re-examination of U.S. Pat. No. 8,241,878, U.S. Control No. 95/002,167, filed Sep. 10, 2012.

U.S. Appl. No. 13/837,893, filed Mar. 15, 2013, Inventors: Flint et al.

U.S. Appl. No. 13/837,921, filed Mar. 15, 2013, Inventors: Flint et al.

Arthur, et al., Contribution of VanY D,D-Carboxypeptidase to Glycopeptide Resistance in *Enterococcus faecalis* by Hydrolysis of Peptidoglycan Precursors, Antimicrob. Agents Chemother. 38:1899-1903, 1994.

Wycoff, et al., Characterization and sequence analysis of a stable cryptic plasmid from *Enterococcus faecium* 226 and development of a stable cloning vector, Appl. Environ. Microbiol. 62:1481-1486, 1996.

Zirkle, et al., Analysis of a 108-kb region of the *Saccharopolyspora spinosa* genome covering the obscurin polyketide synthase locus, DNA Sequence 15:123-134, 2004.

Dickinson, et al., An investigation of the metabolims of valine to isobutyl alcohol in *Saccharomyces cerevisiae*, J. Biol. Chem. 273:25751-25756,1998.

Connor, et al., Engineering of an *Escherichia coli* Strain for the Production of 3-Methyl-1-Butanol, Appl. Environ. Microbiol. 74:5769-5775, 2008.

Eden, et al., Involvement of branched-chain amino acid aminotransferases in the production of fusel alcohols during fermentation in yeast, Appl. Microbiol. Biotechnol. 55:296-300, 2001.

(56) References Cited

OTHER PUBLICATIONS

Eichenbaum, et al., Use of the Lactococcal nisA Promoter to regulate gene expression in gram-positive bacteria: comparison of induction level and promoter strength Appl. Environ. Microbiol. 64:2763-2769, 1998.
Ryan, et al., Subcellular Localization of Isoleucine-Valine Biosynthetic Enzymes in Yeast, J. Bacteriol. 120:631-637, 1974.
Flint, et al., Studies on the active site of dihydroxy-acid dehydratase, Bioorganic Chem. 21:367-385, 1993.
Flint, et al., The Inactivation of Fe—S Cluster Containing Hydrolyases by Superoxide, J. Biol. Chem. 268:22369-22376, 1993.
Fujimoto, et al., pAM401-Based Shuttle Vectors That Enable Overexpression of Promoterless Genes and One-Step Purification of Tag Fusion Proteins Directly from *Enterococcus faecalis*, Appl. Environ. Microbiol. 67:1262-1267, 2001.
Godon, et al., Branched-chain amino acid biosynthesis genes in *Lactococcus lactis* subsp. lactis, J. Bacteriol. 174:6580-6589, 1992.
Gossens, et al., Control of diacetyl formation by the intensification of the anabolic flux of acetohydroxyacid intermediates, European Brewery Covention: Proceedings of the 21st Congress, Madrid, 1987, pp. 553-560.
Malkin, et al., The Reconstitution of Clostridial Ferredoxin, Biochem. Biophys. Res. Comm. 23:822-827, 1996.
Horton, et al., Engineering hybrid genes without the use of restriction enzymes: gene splicing by overlap extension, Gene 77:61-68, 1989.
Imlay, Iron—sulphur clusters and the problem with oxygen, Mol. Microbial. 59:1073-1082, 2006.
Kim, et al., Catalytic promiscuity in dihydroxy-acid dehydratase from the thermoacidophilic archaean *Sulfotobus solfataricus*, J. Biochem. 139: 591-596, 2006.
Kleerbezem, et al., Controlled Gene Expression Systems for Lactic Acid Bacteria: Transferable Nisin-Inducible Expression Cassettes for *Lactococcus, Leuconostoc*, and *Lactobacillus* spp. Appl. Environ. Microbiol. 63:4581-4584, 1997.
Maguin, et al., New thermosensitive plasmid for gram-positive bacteria, J. Bacteriol. 174:5633-5638, 1992.
Liu, et al., Electron Paramagnetic Resonance Evidence for a Novel Interconversion of [3Fe—4S] and [4Fe—4S] Clusters with Endogenous Iron and Sulfide in Anaerobic Ribonucleotide Reductase Activase in Vitro, J. Biol. Chem. 275:12367-12373, 2000.
O'Sullivan, et al., High- and low-copy-number *Lactococcus* shuttle cloning vectors with features for clone screening, Gene 137:227-231, 1993.
Polaina, Cloning of the IL V2, IL V3 and IL V 5 Genese of *Saccharomyces cerevisiae*, Carlsberg Res. Commun., 49:577-584, 1984.
Renault, et al., Plasmid vectors for gram-positive bacteria switching from high to low copy number, Gene 183:175-182, 1996.
Rud, et al., A synthetic promoter library for constitutive gene expression in *Lactobacillus plantarum*, Microbiology 152:1011-1019, 2006.
Rupp, et al., Electron spin relaxation of iron—sulfur proteins studied by microwave power saturation, Biochim. Biophys. Acta 537:255-269, 1978.
Scott, et al., Sequences of versatile broad-host-range vectors of the RK2 family, Plasmid 50:74-79, 2003.
Seffernick, et al., Melamine deaminase and atrazine chlorohydrolase: 98 percent identical but functionally different, J. Bacteriol. 183:2405-2410, 2001.
Sorvig, et al., Plasmid p256 from *Lactobacillus plantarum* represents a new type of replicon in lactic acid bacteria, and contains a toxin-antitoxin-like plasmid maintenance system, Microbiology 151:421-431, 2005.
Tanimoto, et al., Analysis of the Conjugal Transfer System of the Pheromone-Independent Highly Transferable Enterococcus Plasmid pMG1: Identification of a tra Gene (traA) Up-Regulated during Conjugation, J. Bacteriol. 184:5800-5804, 2002.
Thompson, et al., CLUSTAL W: improving the sensitivity of progressive multiple sequence alignment through sequence weighting, position-specific gap penalties and weight matrix choice, Nucleic Acids Research 22:4673-4680, 1994.

van Kranenburg, et al., Functional Analysis of Three Plasmids from *Lactobacillus plantarum*, Appl. Environ. Microbiol. 71:1223-1230, 2005.
Villa, et al., Control of Vicinal Diketone Production by Brewer's Yeast. I. Effects of ilv5 and IL V3 Gene Amplification on Vicinal Diketone Production and IL V Enzyme Activity, Journal of the American Society of Brewing Chemists, 53:49-53, 1995.
Watanabe, et al., Identification and characterization of L-Arabonate dehydratase, L-2-keto-3-deoxyarabonate dehydratase, and L-Arabinolactonase involved in an alternative pathway of L-Arabinose metabolism, J. Biol. Chem. 281:33521-3353, 2006.
Branden, et al., Introduction to Protein Structure, Garland Publishing Inc., New York p. 247, 1991.
Gellissen, et al., Heterologous protein production in yeast, Antonie van Leeuwenhoek 62:79-93, 1992.
Harashima, et al., Heterologous Protein Production by Yeast Host-Vector Systems, Biopress technol. 19:137-158, 1994.
Mendoza-Vega, et al., Industrial production of heterologous proteins by fed-batch cultures of the yeast *Saccharomyces cerevisiae*, FEMS Microbiol. Rev. 15:369-410, 1994.
Roggenkamp, et al., Expression and processing of bacterial δ-lactamase in the yeast *Saccharomyces cerevisiae*, Proc. Natl. Acad. Sci. USA 78:4466-4470, 1981.
Romanos, et al., Foreign Gene Expression in Yeast: a Review. Yeast 8: 423-488, 1992.
Russell, et al., Production of Recombinant Products in Yeast: A Review, Australian J. Biotechol. 5:48-55, 1991.
Chica, et al., Semi-rational approaches to engineering enzyme activity: combining the benefits of directed evolution and rational design, Curr. Opin. Biotechnol. 16:378-384, 2005.
Tokumoto, et al., Genetic analysis of the isc operon in *Escherichia coli* involved in the biogenesis of cellular iron sulfur proteins, J. Biochem. 130:63-71, 2001.
Fontecave, et al., Mechanisms of iron—sulfur cluster assembly; the SUF machinery, J. Biol. Inorganic Chem. 10:713-721, 2005.
Elli, et al., Iron requirement of *Lactobacillus* spp. in completely chemically defined growth media, J. Appl. Microbiol. 88:695-703, 2000.
Herbert, et al., Nutritional Requirements of *Lactobacillus delbrueckii* subsp. lactis in Chemically Defined Medium. Curr. Microbiol. 49:341-345, 2004.
Karlin, et al., Comparative analysis of gene expression among low G+C gram-positive genomes, Proc. Natl. Acad. Sci USA 101:6182-6187, 2004.
Duhutrel, et al., Iron Sources Used by the Nonpathogenic Lactic Acid Bacterium *Lactobacillus sakei* as Revealed by Electron Energy Loss Spectroscopy and Secondary-Ion Mass Spectrometry, Appl. Environ. Microbiol. 76:560-565, 2009.
Neves, et al. Metabolic characterization of *Lactococcus lactis* deficient in lactate dehydrogenase using in vivo 13CNMR, Eur. J. Biochem. 267:3859-3868, 2000.
Chen, Ph.D. Thesis, McGill University, Montreal, Canada, Formation and Analysis of Fusel Alcohols in Beer, 1978.
Broun, et al., Catalytic Plasticity of Fatty Acid Modification Enzymes Underlying Chemical Diversity of Plant Lipids, Science 282:1315-1317, 1998.
Devos, et al. Practical Limits of Function Prediction, Proteins: Structure, Function and Genetics 41:98-107, 2000.
Kisselev, Polypeptide Release Factors in Prokaryotes and Eukaryotes: Same Function, Different Structure, Structure 10:8-9, 2002.
Madera, et al., A comparison of profile hidden Markov model procedures for remote homology detection, Nuc. Acids Res. 30:4321-4328, 2002.
Sen, et al. Developments in Directed Evolution for Improving Enzyme Functions, Appl. Biochem. Biotechnol. 143:212-223, 2007.
Stanke, et al., Gene prediction with hidden Markov model and a new intron submodel, Bioinformatics 19 Suppl.2: 215-225, 2003.
Whisstock, et al., Prediction of protein function from protein sequence and structure, Quarterly Reviews of Biophysics 36:307-340, 2003.

(56) References Cited

OTHER PUBLICATIONS

Wishart, et al., A Single Mutation Converts a Novel Phosphotyrosine Binding Domain into a Dual-specificity Phosphate, J. Biol. Chem. 270:26782-26785, 1995.

Witkowski, et al., Conversion of a beta-Ketoacyl Synthase to a Malonyl Decarboxylase by Replacement of the Active-Site Cysteine with Glutamine, Biochem. 38:11643-11650, 1999.

Chen, et al., Inhibition of Fe—S cluster biosynthesis decreases mitochondrial iron export: Evidence that Yfh1p affects Fe—S cluster synthesis, Proc. Natl. Acad. Sci. 99:12321-12326, 2002.

Jensen, et al., Role of *Saccharomyces cerevisiae* ISA1 and ISA2 in Iron Homeostasis, Mol. Cell Biol. 20:3918-3927, 2000.

Nakamura, et al., Hyperproduction of Recombinant Ferredoxins in *Escherichia coli* by Coexpression of the ORF1-ORF2-iscS-iscU-iscA-hscB-hscA-fdx-ORF3 Gene Cluster, J. Biochem. 126:10-18, 1999.

Garland, et al., *Saccharomyces cerevisiae* ISU1 and ISU2: Members of a Well-conserved Gene Family for Iron—Sulfur Cluster Assembly, J. Mol. Biol. 294:897-907, 1999.

Imbert, et al. On the Iron Requirement of *Lactobacilli* Grown in Chemically Defined Medium, Curr. Microbiol. 37:64-66, 1998.

Pandey, et al., Iron requirement and search for siderophores in lactic acid bacteria, Appl. Microbiol. Biotechnol. 40:735-739, 1994.

Archibald, *Lactobacillus plantarum*, an organism not requiring iron, FEMS Microbiol. Lett. 19:29-32, 1983.

Frohman, et al., Rapid production of full-length cDNAs from rare transcripts: Amplification using a single gene-specific oligonucleotide primer, Proc. Natl. Acad. Sci. 85:8998-9002, 1988.

Shrago, et al.,Conjugal Plasmid Transfer (pAMb1) in *Lactobacillus plantarum*, Appl. Environ. Microbiol. 52:574-576, 1986.

Hartmanis, et al., Diol Metabolism and Diol Dehydratase in *Clostridium glycolicum*, Arch. Biochem. Biophys. 245:144-152, 1986.

Cruz-Rodz, et al., High efficiency introduction of plasmid DNA into glycine treated *Enterococcus faecalis* by electroporation, Mol. Gen. Gent. 224:152-154, 1990.

Jang, et al., New integration vector using a cellulase gene as a screening marker for *Lactobacillus*, Micro. Lett. 24:191-195, 2003.

Horinouchi, et al., Nucleotide Sequence and Functional Map of pE194, a Plasmid That Specifies Inducible Resistance to Macrolide. Lincosamide, and Streptogramin Type B Antibiotics, J. Bacteriol. 150:804-814, 1982.

Loh, et al., Polymerase Chain Reaction with Single-Sided Specificity: Analysis of T Cell Receptor Gamma Chain, Science 243:217-220, 1989.

Mnaimneh, et al., Exploration of Essential Gene Functions via Titratable Promoter Alleles, Cell 118:31-44, 2004.

O'Brien, et al., Insight into the Mechanism of the B12-Independent Glycerol Dehydratase from *Clostridium butyricum*: Preliminary Biochemical and Structural Characterization, Biochemistry 43:4635-4645, 2004.

O'Hara, et al. One-sided polymerase chain reaction: The amplification of cDNA, Proc. Natl. Acad. Sci. 86:5673-5677, 1989.

Scott, et al., Whole-Genome Transcription Profiling Reveals Genes Up-Regulated by Growth on Fucose in the Human Gut Bacterium "Roseburia inulinivorans," J. Bacteriol. 188:4340-4349, 2006.

Hols, et al., Use of Homologous Expression-Secretion Signals and Vector-Free Stable Chromosomal Integration in Engineering of *Lactobacillus plantarum* for oL-Amylase and Levanase Expression, Appl. Environ. Microbiol. 60:1401-1403, 1994.

Tabor, et al., A bacteriophage T7 RNA polymerase/promoter system for controlled exclusive expression of specific genes, Proc. Natl. Acad. Sci. 82:1074-1078, 1985.

Van Ness, et al., The use of oligodeoxynucleotide probes in chaotrope-based hybridization solutions, Nucl. Acid Res. 19:5143-5151, 1991.

Wach, et al., New Heterologous Modules for Classical or PCR-based Gene Disruptions in *Saccharomyces cerevisiae*, Yeast 10:1793-1808, 1994.

Walker, et al., Isothermal in vitro amplification of DNA by a restriction enzyme/DNA polymerase system, Proc. Natl. Acad. Sci. 89:392-396, 1992.

Ferain, et al., *Lactobacillus plantarum* IdhL gene: Overexpression and Deletion, J. Bact. 176:596, 1994.

Bringel, et al., Optimized transformation by electroporation of *Lactobacillus plantarum* strains with plasmid vectors, Appl. Microbiol. Biotechnol. 33:664-670, 1990.

Alegre, et al., Transformation of *Lactobacillus plantarum* by electroporation with in vitro modified plasmid DNA, FEMS Microbiol. Lett. 241:73-77, 2004.

Rychlik, In Methods in Molecular Biology, White, B. A. Ed., (1993) vol. 15, pp. 31-39, PCR Protocols: Current Methods and Applications. Humania: Totowa, NJ.

UniProtKB/Swiss-Prot: Q8DRT7, Dihydroxy-acid dehydratase, ILVD_STRUM, *Streptococcus mutans*, Feb. 22, 2012.

GenBank ADA64951, Dihydroxy-acid dehydratase [*Lactococcus lactis* subsp. lactis KF147], Jan. 30, 2014.

NCBI Reference Sequence: WP_011676306 (formerly YP_809259) Dihydroxy-acid dehydratase [*Lactococcus lactis* subsp. cremoris SK11], Apr. 27, 2015.

GenBank AF508808, *Lactobacillus plantarum* plasmid pLF1 putative integrase/recombinase. ISLP1 transposase, and cold shock protein genes, complete cds, Jun. 24, 2002.

GenBank ABH11633, Putative ABC transporter ABC5MC5 [*Lactobacillus helveticus* CNRZ32], Jun. 14, 2007.

UniProtKB/Swiss-Prot: Q1WS05, Iron-sulfur cluster assembly/repair protein *Lactobacillus salivarius* UCC118, Oct. 31, 2006.

UniProt E1TL94, Cysteine desulfurase, *Lactobacillus plantarum*, Feb. 22, 2012.

UniProt E1TPR8, NifU-like protein, *Lactobacillus plantarum*, Feb. 22, 2012.

NCBI Reference Sequence: NC_004567, *Lactobacillus plantarum* WCFS1, complete genome, Mar. 25, 2015.

\* cited by examiner

US 9,297,016 B2

ACTIVITY OF FE—S CLUSTER REQUIRING PROTEINS

CROSS-REFERENCE TO RELATED APPLICATIONS

This application claims the benefit of U.S. Provisional Appl. No. 61/305,333, filed Feb. 17, 2010, which is incorporated by reference in its entirety.

SEQUENCE LISTING INFORMATION

The content of the electronically submitted sequence listing in ASCII text file CL4842sequencelisting.txt filed with the application is incorporated herein by reference in its entirety.

BACKGROUND OF THE INVENTION

1. Field of the Invention

This invention relates generally to the fields of microbiology and biochemistry. Specifically, the present invention is related to a recombinant host cell, in particular a yeast cell, comprising a dihydroxy-acid dehydratase polypeptide. The invention is also related to a recombinant host cell having increased specific activity of the dihydroxy-acid dehydratase polypeptide as a result of increased expression of the polypeptide, modulation of the Fe—S cluster biosynthesis activity of the cell, or a combination thereof. The present invention also includes methods of using the host cells, as well as methods for identifying polypeptides that increase the flux in an Fe—S cluster biosynthesis pathway in a host cell.

2. Background of the Invention

Iron-sulfur (Fe—S) clusters serve as cofactors or prosthetic groups essential for the normal function of the class of proteins that contain them. In the class of Fe—S cluster containing proteins, the Fe—S clusters have been found to play several roles. When proteins of this class are first synthesized by the cell, they lack the Fe—S clusters required for their proper function and are referred to as apoproteins. Fe—S clusters are made in a series of reactions by proteins involved in Fe—S cluster biosynthesis and are transferred to the apo-proteins to form the functional Fe—S cluster containing holoproteins.

One such protein that requires Fe—S clusters for proper function is dihydroxy-acid dehydratase (DHAD) (E.C. 4.2.1.9). DHAD catalyzes the conversion of 2,3-dihydroxyisovalerate to α-ketoisovalerate, and of 2,3-dihydroxymethylvalerate to α-ketomethylvalerate. The DHAD enzyme is part of naturally occurring biosynthetic pathways producing the branched chain amino acids, (i.e., valine, isoleucine, leucine), and pantothenic acid (vitamin B5). DHAD catalyzed conversion of 2,3-dihydroxyisovalerate to α-ketoisovalerate is also a common step in the multiple isobutanol biosynthetic pathways that are disclosed in U.S. Patent Appl. Pub. No. US 20070092957 A1, incorporated by reference herein. Disclosed therein is, e.g., the engineering of recombinant microorganisms for the production of isobutanol.

High levels of DHAD activity are desired for increased production of products from biosynthetic pathways that include this enzyme activity, including, e.g., enhanced microbial production of branched chain amino acids, pantothenic acid, and isobutanol. Isobutanol, in particular, is useful as a fuel additive, and its ready availability may reduce the demand for petrochemical fuels. However, since all known DHAD enzymes require a Fe—S cluster for their function, they must be expressed in a host having the genetic machinery to provide the Fe—S clusters required by these proteins. In yeast, mitochondria play an essential role in Fe—S cluster biosynthesis. If the DHAD is to be functionally expressed in yeast cytosol, a system to transport the requisite Fe—S precursor or signal from mitochondria and assemble the Fe—S cluster on the cytosolic apoprotein is required. Prior to the work of the present inventors, it was previously unknown whether yeast could provide Fe—S clusters for any DHAD located in the cytoplasm (since native yeast DHAD is located in the mitochondria) and more importantly when the DHAD is expressed at high levels in the cytoplasm Under certain conditions the rate of synthesis of Fe—S cluster requiring apo-proteins may exceed the cell's ability to synthesize and assemble Fe—S clusters for them. Clusterless apo-proteins that accumulate under these conditions cannot carry out their normal function. Such conditions can include 1) the expression of a heterologous Fe—S cluster requiring protein especially in high amounts, 2) the expression of a native Fe—S cluster biosynthesis protein at higher levels than normal, or 3) a state where the host cell's ability to synthesize Fe—S clusters is debilitated.

BRIEF SUMMARY OF THE INVENTION

Disclosed herein is the surprising discovery that recombinant host cells expressing a high level of a heterologous Fe—S cluster requiring protein can supply the complement of Fe—S clusters for that protein if the level(s) of at least one Fe uptake, utilization, and/or Fe—S cluster biosynthesis protein are altered.

Provided herein are recombinant host cells comprising at least one heterologous polynucleotide encoding a polypeptide having dihydroxy-acid dehydratase activity wherein said at least one heterologous polynucleotide comprises a high copy number plasmid or a plasmid with a copy number that can be regulated. Also provided are recombinant host cells comprising at least one heterologous polynucleotide encoding a polypeptide having dihydroxy-acid dehydratase activity wherein said at least one heterologous polynucleotide is integrated at least once in the recombinant host cell DNA. Also provided are recombinant host cells comprising at least one heterologous polynucleotide encoding a polypeptide having dihydroxy-acid dehydratase activity, wherein said host cell comprises at least one deletion, mutation, and/or substitution in an endogenous gene encoding a polypeptide affecting iron metabolism or Fe—S cluster biosynthesis. Also provided are recombinant host cells comprising at least one heterologous polynucleotide encoding a polypeptide having dihydroxy-acid dehydratase activity and at least one heterologous polynucleotide encoding a polypeptide affecting iron metabolism or Fe—S cluster biosynthesis.

In embodiments, said heterologous polynucleotide encoding a polypeptide affecting Fe—S cluster biosynthesis is selected from the group consisting of the genes in Tables 7, 8 and 9. In embodiments, said heterologous polynucleotide encoding a polypeptide affecting Fe—S cluster biosynthesis is selected from the group consisting of AFT1, AFT2, CCC1, FRA2, and GRX3, and combinations thereof. In embodiments, polypeptide is encoded by a polynucleotide that is constitutive mutant. In embodiments, said constitutive mutant is selected from the group consisting of AFT1 L99A, AFT1 L102A, AFT1 C291F, AFT1 C293F, and combinations thereof. In embodiments said polypeptide affecting Fe—S cluster biosynthesis is encoded by a polynucleotide comprising a high copy number plasmid or a plasmid with a copy number that can be regulated. In embodiments, said polypeptide affecting Fe—S cluster biosynthesis is encoded by a polynucleotide integrated at least once in the recombinant host cell DNA. In embodiments, the at least one deletion, mutation, and/or substitution in an endogenous gene encoding a polypeptide affecting Fe—S cluster biosynthesis is selected from the group consisting of CCC1, FRA2, and GRX3, and combinations thereof. In embodiments, the at least one heterologous polynucleotide encoding a polypeptide affecting Fe—S cluster biosynthesis is selected from the group consisting of AFT1, AFT2, their mutants, and combinations thereof.

In embodiments, said at least one heterologous polynucleotide encoding a polypeptide having dihydroxy-acid dehydratase activity is expressed in multiple copies. In embodiments, said at least one heterologous polynucleotide comprises a high copy number plasmid or a plasmid with a copy number that can be regulated. In embodiments, said at least one heterologous polynucleotide is integrated at least once in the recombinant host cell DNA. In embodiments, said Fe—S cluster biosynthesis is increased compared to a recombinant host cell having endogenous Fe—S cluster biosynthesis.

In embodiments, said host cell is a yeast host cell. In embodiments, said yeast host cell is selected from the group consisting of *Saccharomyces, Schizosaccharomyces, Hansenula, Candida, Kluyveromyces, Yarrowia, Issatchenkia* and *Pichia*.

In embodiments, said heterologous polypeptide having dihydroxy-acid dehydratase activity is expressed in the cytosol of the host cell. In embodiments, said heterologous polypeptide having dihydroxy-acid dehydratase activity has an amino acid sequence that matches the Profile HMM of Table 12 with an E value of $<10^{-5}$ wherein the polypeptide further comprises all three conserved cysteines, corresponding to positions 56, 129, and 201 in the amino acids sequences of the *Streptococcus mutans* DHAD enzyme corresponding to SEQ ID NO:168. In embodiments, said heterologous polypeptide having dihydroxy-acid dehydratase activity has an amino acid sequence with at least about 90% identity to SEQ ID NO: 168 or SEQ ID NO: 232. In embodiments said polypeptide having dihydroxy-acid dehydratase activity has a specific activity selected from the group consisting of: greater than about 5-fold with respect to the control host cell comprising at least one heterologous polynucleotide encoding a polypeptide having dihydroxy-acid dehydratase activity, greater than about 8-fold with respect to the control host cell comprising at least one heterologous polynucleotide encoding a polypeptide having dihydroxy-acid dehydratase activity, or greater than about 10-fold with respect to the control host cell comprising at least one heterologous polynucleotide encoding a polypeptide having dihydroxy-acid dehydratase activity. In embodiments said polypeptide having dihydroxy-acid dehydratase activity has a specific activity selected from the group consisting of: greater than about 3-fold with respect to a control host cell comprising at least one heterologous polynucleotide encoding a polypeptide having dihydroxy-acid dehydratase activity and greater than about 6-fold with respect to the control host cell comprising at least one heterologous polynucleotide encoding a polypeptide having dihydroxy-acid dehydratase activity. In embodiments, said polypeptide having dihydroxy-acid dehydratase activity has a specific activity selected from the group consisting of: greater than about 0.25 U/mg; greater than about 0.3 U/mg; greater than about 0.5 U/mg; greater than about 1.0 U/mg; greater than about 1.5 U/mg; greater than about 2.0 U/mg; greater than about 3.0 U/mg; greater than about 4.0 U/mg; greater than about 5.0 U/mg; greater than about 6.0 U/mg; greater than about 7.0 U/mg; greater than about 8.0 U/mg; greater than about 9.0 U/mg; greater than about 10.0 U/mg; greater than about 20.0 U/mg; and greater than about 50.0 U/mg.

In embodiments said recombinant host cell produces isobutanol, and in embodiments, said recombinant host cell comprises an isobutanol biosynthetic pathway.

Also provided herein are methods of making a product comprising: providing a recombinant host cell; and contacting the recombinant host cell of with a fermentable carbon substrate in a fermentation medium under conditions wherein said product is produced, wherein the product is selected from the group consisting of branched chain amino acids, pantothenic acid, 2-methyl-1-butanol, 3-methyl-1-butanol, isobutanol, and combinations thereof. In embodiments, the methods further comprise optionally recovering said product. In embodiments, the methods further comprise recovering said product.

Also provided are methods of making isobutanol comprising: providing a recombinant host cell; contacting the recombinant host cell with a fermentable carbon substrate in a fermentation medium under conditions wherein isobutanol is produced. In embodiments, the methods further comprise optionally recovering said isobutanol. In embodiments, the methods further comprise recovering said isobutanol.

Also provided are methods for the conversion of 2,3-dihydroxyisovalerate to α-ketoisovalerate comprising: providing a recombinant host cell; growing the recombinant host cell of under conditions where the 2,3-dihydroxyisovalerate is converted to α-ketoisovalerate. In embodiments, the conversion of 2,3-dihydroxyisovalerate to α-ketoisovalerate compared to a control host cell comprising at least one heterologous polynucleotide encoding a polypeptide having dihydroxy-acid dehydratase activity is increased in an amount selected from the group consisting of: (a) at least about 5%; (b) at least about 10%; (c) at least about 15%; (d) at least about 20%; (e) at least about 25%; (f) at least about 30%; (g) at least about 35%; (h) at least about 40%; (i) at least about 45%; (j) at least about 50%; (k) at least about 60%; (l) at least about 70%; (m) at least about 80%; (n) at least about 90%; and (o) at least about 95%.

Also provided are methods for increasing the specific activity of a heterologous polypeptide having dihydroxy-acid dehydratase activity in a recombinant host cell comprising: providing a recombinant host cell; and growing the recombinant host cell of under conditions whereby the heterologous polypeptide having dihydroxy-acid dehydratase activity is expressed in functional form having a specific activity greater than the same host cell lacking said heterologous polypeptide.

Also provided are methods for increasing the flux in an Fe—S cluster biosynthesis pathway in a host cell comprising: providing a recombinant host cell; and growing the recombinant host cell under conditions whereby the flux in the Fe—S cluster biosynthesis pathway in the host cell is increased.

Also provide are methods of increasing the activity of an Fe—S cluster requiring protein in a recombinant host cell comprising: providing a recombinant host cell comprising an Fe—S cluster requiring protein; changing the expression or activity of a polypeptide affecting Fe—S cluster biosynthesis in said host cell; and growing the recombinant host cell under conditions whereby the activity of the Fe—S cluster requiring protein is increased. In embodiments, said increase in activity is an amount selected from the group consisting of: greater than about 10%; greater than about 20%; greater than about 30%; greater than about 40%; greater than about 50%; greater than about 60%; greater than about 70%; greater than about 80%; greater than about 90%; and greater than about 95%, 98%, or 99%. In embodiments, the increase in activity is in an amount selected from the group consisting of: greater than about 5-fold; greater than about 8-fold; greater than about 10-fold. In embodiments, the increase in activity is in an amount selected from the group consisting of: greater than about 3-fold and greater than about 6-fold.

A method for identifying polypeptides that increase the flux in an Fe—S cluster biosynthesis pathway in a host cell comprising: changing the expression or activity of a polypeptide affecting Fe—S cluster biosynthesis; measuring the activity of a heterologous Fe—S cluster requiring protein; and comparing the activity of the heterologous Fe—S cluster requiring protein measured in the presence of the change in expression or activity of a polypeptide to the activity of the heterologous Fe—S cluster requiring protein measured in the absence of the change in expression or activity of a polypeptide, wherein an increase in the activity of the heterologous Fe—S cluster requiring protein indicates an increase in the flux in said Fe—S cluster biosynthesis pathway.

Provided herein are methods for identifying polypeptides that increase the flux in an Fe—S cluster biosynthesis pathway in a host cell comprising: changing the expression or activity of a polypeptide affecting Fe—S cluster biosynthesis; measuring the activity of a polypeptide having dihydroxy-acid dehydratase activity; and comparing the activity of the polypeptide having dihydroxy-acid dehydratase activity measured in the presence of the change to the activity of the polypeptide having dihydroxy-acid dehydratase activity measured in the absence of change, wherein an increase in the activity of the polypeptide having dihydroxy-acid dehydratase activity indicates an increase in the flux in said Fe—S cluster biosynthesis pathway.

In embodiments, said changing the expression or activity of a polypeptide affecting Fe—S cluster biosynthesis comprises deleting, mutating, substituting, expressing, up-regulating, down-regulating, altering the cellular location, altering the state of the protein, and/or adding a cofactor. In embodiments, the Fe—S cluster requiring protein has dihydroxy-acid dehydratase activity and wherein said Fe—S cluster requiring protein having dihydroxy-acid dehydratase activity has an amino acid sequence that matches the Profile HMM of Table 12 with an E value of <$10^{-5}$ wherein the polypeptide further comprises all three conserved cysteines, corresponding to positions 56, 129, and 201 in the amino acids sequences of the Streptococcus mutans DHAD enzyme corresponding to SEQ ID NO:168. In embodiments, the polypeptide affecting Fe—S cluster biosynthesis is selected from the group consisting of the genes in Tables 7, 8 and 9.

Also provided are recombinant host cells comprising at least one polynucleotide encoding a polypeptide identified by the methods provided herein. In embodiments, said host cell further comprises at least one heterologous polynucleotide encoding a polypeptide having dihydroxy-acid dehydratase activity. In embodiments, said heterologous polynucleotide encoding a polypeptide having dihydroxy-acid dehydratase activity is expressed in multiple copies. In embodiments, said heterologous polynucleotide comprises a high copy number plasmid or a plasmid with a copy number that can be regulated. In embodiments, said heterologous polynucleotide is integrated at least once in the recombinant host cell DNA.

In embodiments, said host cell is a yeast host cell. In embodiments, said yeast host cell is selected from the group consisting of Saccharomyces, Schizosaccharomyces, Hansenula, Candida, Kluyveromyces, Yarrowia, Issatchenkia, and Pichia. In embodiments, said heterologous polypeptide having dihydroxy-acid dehydratase activity is expressed in the cytosol of the host cell. In embodiments, said heterologous polypeptide having dihydroxy-acid dehydratase activity has an amino acid sequence that matches the Profile HMM of Table 12 with an E value of <$10^{-5}$ wherein the polypeptide further comprises all three conserved cysteines, corresponding to positions 56, 129, and 201 in the amino acids sequences of the Streptococcus mutans DHAD enzyme corresponding to SEQ ID NO:168. In embodiments, said recombinant host cell produces a product selected from the group consisting of branched chain amino acids, pantothenic acid, 2-methyl-1-butanol, 3-methyl-1-butanol, isobutanol, and combinations thereof. In embodiments, recombinant host cell produces isobutanol. In embodiments, said recombinant host cell comprises an isobutanol biosynthetic pathway. In embodiments said isobutanol biosynthetic pathway comprises at least one polypeptide encoded by a polynucleotide heterologous to the host cell. In embodiments, said isobutanol biosynthetic pathway comprises at least two polypeptides encoded by polynucleotides heterologous to the host cell.

In embodiments, monomers of the polypeptides of the invention having dihydroxy-acid dehydratase activity have an Fe—S cluster loading selected from the group consisting of: (a) at least about 10%; (b) at least about 15%; (c) at least about 20%; (d) at least about 25%; (e) at least about 30%; (f) at least about 35%; (g) at least about 40%; (h) at least about 45%; (i) at least about 50%; (j) at least about 60%; (k) at least about 70%; (l) at least about 80%; (m) at least about 90%; and (n) at least about 95%.

BRIEF DESCRIPTION OF THE DRAWINGS/FIGURES

Figure 1A:
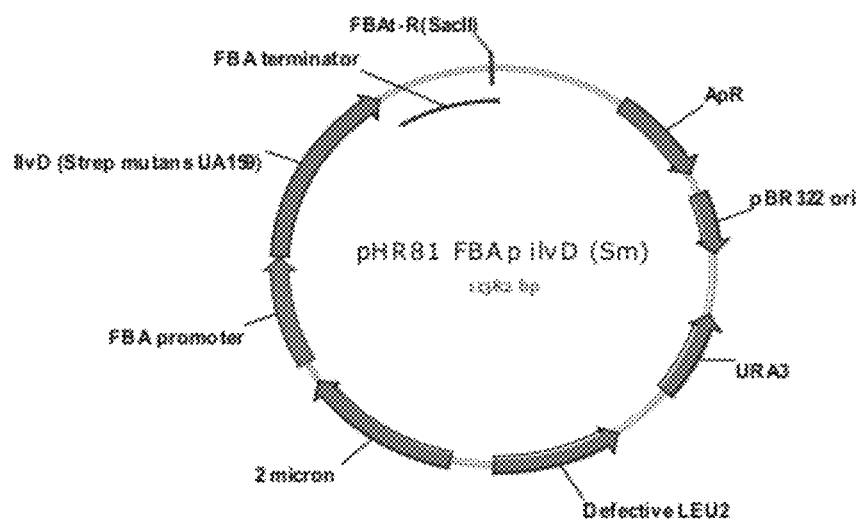
FIG. 1A depicts a vector map of a vector for overexpression of the IlvD gene from S. mutans.

Table 12 is a table of the Profile HMM for dihydroxy-acid dehydratases based on enzymes with assayed function prepared as described in U.S. patent application Ser. No. 12/569,636, filed Sep. 29, 2009. Table 12 is submitted herewith electronically and is incorporated herein by reference.

DETAILED DESCRIPTION OF THE INVENTION

Described herein is a method to increase the fraction of the Fe—S cluster requiring proteins that are loaded with Fe—S clusters. Also described are recombinant host cells that express functional Fe—S cluster requiring proteins, such as DHAD enzymes, and at least one heterologous Fe uptake, utilization, or Fe—S cluster biosynthesis protein, recombinant host cells that express functional DHAD enzymes and comprise at least one deletion, mutation, and/or substitution in a native protein involved in Fe utilization or Fe—S cluster biosynthesis, or recombinant host cells comprising combinations thereof. In addition, the present invention describes a method to identify polypeptides that increase the flux in an Fe—S cluster biosynthesis pathway in a host cell. Also described is a method to identify polypeptides that alter the activity of an Fe—S cluster requiring protein.

Definitions

Unless defined otherwise, all technical and scientific terms used herein have the same meaning as commonly understood by one of ordinary skill in the art to which this invention belongs. In case of conflict, the present application including the definitions will control. Also, unless otherwise required by context, singular terms shall include pluralities and plural terms shall include the singular. All publications, patents and other references mentioned herein are incorporated by reference in their entireties for all purposes.

In order to further define this invention, the following terms and definitions are herein provided.

As used herein, the terms "comprises," "comprising," "includes," "including," "has," "having," "contains" or "containing," or any other variation thereof, will be understood to imply the inclusion of a stated integer or group of integers but not the exclusion of any other integer or group of integers. For example, a composition, a mixture, a process, a method, an article, or an apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the term "consists of," or variations such as "consist of" or "consisting of," as used throughout the specification and claims, indicate the inclusion of any recited integer or group of integers, but that no additional integer or group of integers may be added to the specified method, structure, or composition.

As used herein, the term "consists essentially of," or variations such as "consist essentially of" or "consisting essentially of," as used throughout the specification and claims, indicate the inclusion of any recited integer or group of integers, and the optional inclusion of any recited integer or group of integers that do not materially change the basic or novel properties of the specified method, structure or composition. See M.P.E.P. §2111.03.

Also, the indefinite articles "a" and "an" preceding an element or component of the invention are intended to be nonrestrictive regarding the number of instances, i.e., occurrences of the element or component. Therefore "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the application.

As used herein, the term "about" modifying the quantity of an ingredient or reactant of the invention employed refers to variation in the numerical quantity that can occur, for example, through typical measuring and liquid handling procedures used for making concentrates or solutions in the real world; through inadvertent error in these procedures; through differences in the manufacture, source, or purity of the ingredients employed to make the compositions or to carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, preferably within 5% of the reported numerical value.

The term "isobutanol biosynthetic pathway" refers to an enzyme pathway to produce isobutanol from pyruvate.

The term "a facultative anaerobe" refers to a microorganism that can grow in both aerobic and anaerobic environments.

The term "carbon substrate" or "fermentable carbon substrate" refers to a carbon source capable of being metabolized by host organisms of the present invention and particularly carbon sources selected from the group consisting of monosaccharides, oligosaccharides, polysaccharides, and one-carbon substrates or mixtures thereof.

The term "Fe—S cluster biosynthesis" refers to biosynthesis of Fe—S clusters, including, e.g., the assembly and loading of Fe—S clusters. The term "Fe—S cluster biosynthesis genes", "Fe—S cluster biosynthesis proteins" or "Fe—S cluster biosynthesis pathway" refers to those polynucleotides/genes and the encoded polypeptides that are involved in the biosynthesis of Fe—S clusters, including, e.g., the assembly and loading of Fe—S clusters.

The term "Fe uptake and utilization" refers to processes which can effect Fe—S cluster biosynthesis such as Fe sensing, uptake, utilization, and homeostasis. "Fe uptake and utilization genes" refers to those polynucleotides/genes and the encoded polypeptides that are involved in Fe uptake, utilization, and homeostasis. Some of these polynucleotides/genes are contained in the "Fe Regulon" that has been described in the literature and is further described hereafter. As used herein, Fe uptake and utilization genes and Fe—S cluster biosynthesis genes can encode a polypeptide affecting Fe—S cluster biosynthesis.

The term "specific activity" as used herein is defined as the units of activity in a given amount of protein. Thus, the specific activity is not directly measured but is calculated by dividing 1) the activity in units/ml of the enzyme sample by 2) the concentration of protein in that sample, so the specific activity is expressed as units/mg. The specific activity of a sample of pure, fully active enzyme is a characteristic of that enzyme. The specific activity of a sample of a mixture of proteins is a measure of the relative fraction of protein in that sample that is composed of the active enzyme of interest. The specific activity of a polypeptide of the invention may be selected from greater than about 0.25 U/mg; greater than about 0.3 U/mg; greater than about 0.4 U/mg; greater than about 0.5 U/mg; greater than about 0.6 U/mg; greater than about 0.7 U/mg; greater than about 0.8 U/mg; greater than about 0.9 U/mg; greater than about 1.0 U/mg; greater than about 1.5 U/mg; greater than about 2.0 U/mg; greater than about 2.5 U/mg; greater than about 3.0 U/mg; greater than about 3.5 U/mg; greater than about 4.0 U/mg; greater than about 5.5 U/mg; greater than about 5.0 U/mg; greater than about 6.0 U/mg; greater than about 6.5 U/mg; greater than about 7.0 U/mg; greater than about 7.5 U/mg; greater than about 8.0 U/mg; greater than about 8.5 U/mg; greater than about 9.0 U/mg; greater than about 9.5 U/mg; greater than about 10.0 U/mg; greater than about 20.0 U/mg; or greater than about 50.0 U/mg. In one embodiment, the specific activity of a polypeptide of the invention is greater than about 0.25 U/mg. In another embodiment, the specific activity is greater than about 1.0 U/mg. In yet another embodiment, the specific activity is greater than about 2.0 U/mg or greater than about 3.0 U/mg.

The term "polynucleotide" is intended to encompass a singular nucleic acid as well as plural nucleic acids, and refers to a nucleic acid molecule or construct, e.g., messeger RNA (mRNA) or plasmid DNA (pDNA). A polynucleotide can contain the nucleotide sequence of the full-length cDNA sequence, or a fragment thereof, including the untranslated 5' and 3' sequences and the coding sequences. The polynucleotide can be composed of any polyribonucleotide or polydeoxyribonucleotide, which may be unmodified RNA or DNA or modified RNA or DNA. For example, polynucleotides can be composed of single- and double-stranded DNA, DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded or a mixture of single- and double-stranded regions. "Polynucleotide" embraces chemically, enzymatically, or metabolically modified forms.

A polynucleotide sequence may be referred to as "isolated," in which it has been removed from its native environment. For example, a heterologous polynucleotide encoding a polypeptide or polypeptide fragment having dihydroxy-acid dehydratase activity contained in a vector is considered isolated for the purposes of the present invention. Further examples of an isolated polynucleotide include recombinant polynucleotides maintained in heterologous host cells or purified (partially or substantially) polynucleotides in solution. Isolated polynucleotides or nucleic acids according to the present invention further include such molecules produced synthetically. An isolated polynucleotide fragment in the form of a polymer of DNA may be comprised of one or more segments of cDNA, genomic DNA or synthetic DNA.

The term "gene" refers to a polynucleotide that is capable of being expressed as a specific protein, optionally including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature.

As used herein, a "coding region" is a portion of nucleic acid which consists of codons translated into amino acids. Although a "stop codon" (TAG, TGA, or TAA) is not translated into an amino acid, it may be considered to be part of a coding region, but any flanking sequences, for example promoters, ribosome binding sites, transcriptional terminators, introns, and the like, are not part of a coding region. Two or more coding regions of the present invention can be present in a single polynucleotide construct, e.g., on a single vector, or in separate polynucleotide constructs, e.g., on separate (different) vectors. Furthermore, any vector may contain a single coding region, or may comprise two or more coding regions.

In addition, a vector, polynucleotide, or nucleic acid of the invention may encode heterologous coding regions.

The term "endogenous," when used in reference to a polynucleotide, a gene, or a polypeptide refers to a native polynucleotide or gene in its natural location in the genome of an organism, or for a native polypeptide, is transcribed and translated from this location in the genome.

The term "heterologous" when used in reference to a polynucleotide, a gene, or a polypeptide refers to a polynucleotide, gene, or polypeptide not normally found in the host organism. "Heterologous" also includes a native coding region, or portion thereof, that is reintroduced into the source organism in a form that is different from the corresponding native gene, e.g., not in its natural location in the organism's genome. The heterologous polynucleotide or gene may be introduced into the host organism by, e.g., gene transfer. A heterologous gene may include a native coding region with non-native regulatory regions that is reintroduced into the native host. A "transgene" is a gene that has been introduced into the genome by a transformation procedure.

The term "recombinant genetic expression element" refers to a nucleic acid fragment that expresses one or more specific proteins, including regulatory sequences preceding (5' non-coding sequences) and following (3' termination sequences) coding sequences for the proteins. A chimeric gene is a recombinant genetic expression element. The coding regions of an operon may form a recombinant genetic expression element, along with an operably linked promoter and termination region.

"Regulatory sequences" refers to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, enhancers, operators, repressors, transcription termination signals, translation leader sequences, introns, polyadenylation recognition sequences, RNA processing site, effector binding site and stem-loop structure.

The term "promoter" refers to a nucleic acid sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic nucleic acid segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters". "Inducible promoters," on the other hand, cause a gene to be expressed when the promoter is induced or turned on by a promoter-specific signal or molecule. It is further recognized that since in most cases the exact boundaries of regulatory sequences have not been completely defined, DNA fragments of different lengths may have identical promoter activity.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

The term "expression", as used herein, refers to the transcription and accumulation of sense (mRNA) or antisense RNA derived from the nucleic acid fragment of the invention. Expression may also refer to translation of mRNA into a polypeptide. The process includes any manifestation of the functional presence of the expressed polynucleotide, gene, or polypeptide within the cell including, without limitation, gene knockdown as well as both transient expression and stable expression.

The term "over-expression", as used herein, refers to expression that is higher than endogenous expression of the same or related polynucleotide or gene. A heterologous polynucleotide or gene is also over-expressed if its expression is higher than that of a comparable endogenous gene, or if its expression is higher than that of the same polynucleotide or gene introduced by a means that does not overexpress the polynucleotide or gene. For example, a polynucleotide can be expressed in a host cell from a low copy number plasmid, which is present in only limited or few copies, and the same polynucleotide can be over-expressed in a host cell from a high copy number plasmid or a plasmid with a copy number that can be regulated, which is present in multiple copies. Any means can be used to over-express a polynucleotide, so long as it increases the copies of the polynucleotide in the host cell. In addition to using a high copy number plasmid, or a plasmid with a copy number that can be regulated, a polynucleotide can be over-expressed by multiple chromosomal integrations.

Expression or over-expression of a polypeptide of the invention in a recombinant host cell can be quantified according to any number of methods known to the skilled artisan and can be represented, e.g., by a percent of total cell protein. The percent of total protein can be an amount selected from greater than about 0.001% of total cell protein; greater than about 0.01% of total cell protein; greater than about 0.1% of total cell protein; greater than about 0.5% of total cell protein; greater than about 1.0% of total cell protein; greater than about 2.0% of total cell protein; greater than about 3% of total cell protein; greater than about 4.0% of total cell protein; greater than about 5% of total cell protein; greater than about 6.0% of total cell protein; greater than about 7.0% of total cell protein; greater than about 8.0% of total cell protein; greater than about 9.0% of total cell protein; greater than about 10% of total cell protein; or greater than about 20% of total cell protein. In one embodiment, the amount of polypeptide expressed is greater that about 0.5% of total cell protein. In another embodiment, the amount of polypeptide expressed is greater than about 1.0% of total cell protein or greater than about 2.0% of total cell protein.

As used herein the term "transformation" refers to the transfer of a nucleic acid fragment into a host organism, resulting in genetically stable inheritance with or without selections. Host organisms containing the transformed nucleic acid fragments are referred to as "transgenic" or "recombinant" or "transformed" organisms.

The terms "plasmid" and "vector" as used herein, refer to an extra chromosomal element often carrying genes which are not part of the central metabolism of the cell, and usually in the form of circular double-stranded DNA molecules. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell.

As used herein the term "codon degeneracy" refers to the nature in the genetic code permitting variation of the nucleotide sequence without effecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA. Such optimization includes replacing at least one, or more than one, or a significant number, of codons with one or more codons that are more frequently used in the genes of that organism.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" which shows which codons encode which amino acids is reproduced herein as Table 1. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE 1

The Standard Genetic Code

|   | T | C | A | G |
|---|---|---|---|---|
| T | TTT Phe (F)<br>TTC "<br>TTA Leu (L)<br>TTG " | TCT Ser (S)<br>TCC "<br>TCA "<br>TCG " | TAT Tyr (Y)<br>TAC "<br>TAA Stop<br>TAG Stop | TGT Cys (C)<br>TGC "<br>TGA Stop<br>TGG Trp (W) |
| C | CTT Leu (L)<br>CTC "<br>CTA "<br>CTG " | CCT Pro (P)<br>CCC "<br>CCA "<br>CCG " | CAT His (H)<br>CAC "<br>CAA Gln (Q)<br>CAG " | CGT Arg (R)<br>CGC "<br>CGA "<br>CGG " |
| A | ATT Ile (I)<br>ATC "<br>ATA "<br>ATG Met (M) | ACT Thr (T)<br>ACC "<br>ACA "<br>ACG " | AAT Asn (N)<br>AAC "<br>AAA Lys (K)<br>AAG " | AGT Ser (S)<br>AGC "<br>AGA Arg (R)<br>AGG " |
| G | GTT Val (V)<br>GTC "<br>GTA "<br>GTG " | GCT Ala (A)<br>GCC "<br>GCA "<br>GCG " | GAT Asp (D)<br>GAC "<br>GAA Glu (E)<br>GAG " | GGT Gly (G)<br>GGC "<br>GGA "<br>GGG " |

Many organisms display a bias for use of particular codons to code for insertion of a particular amino acid in a growing peptide chain. Codon preference, or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

Given the large number of gene sequences available for a wide variety of animal, plant and microbial species, it is possible to calculate the relative frequencies of codon usage. Codon usage tables are readily available, for example, at the "Codon Usage Database" available at the Kazusa DNA Research Institute, Japan, and these tables can be adapted in a number of ways. See Nakamura, Y., et al. *Nucl. Acids Res.* 28:292 (2000). Codon usage tables for yeast, calculated from GenBank Release 128.0 [15 Feb. 2002], are reproduced below as Table 2. This table uses mRNA nomenclature, and so instead of thymine (T) which is found in DNA, the tables use uracil (U) which is found in RNA. Table 2 has been adapted so that frequencies are calculated for each amino acid, rather than for all 64 codons.

TABLE 2

Codon Usage Table for *Saccharomyces cerevisiae* Genes

| Amino Acid | Codon | Number | Frequency per thousand |
|---|---|---|---|
| Phe | UUU | 170666 | 26.1 |
| Phe | UUC | 120510 | 18.4 |
| Leu | UUA | 170884 | 26.2 |
| Leu | UUG | 177573 | 27.2 |
| Leu | CUU | 80076 | 12.3 |
| Leu | CUC | 35545 | 5.4 |
| Leu | CUA | 87619 | 13.4 |
| Leu | CUG | 68494 | 10.5 |
| Ile | AUU | 196893 | 30.1 |
| Ile | AUC | 112176 | 17.2 |
| Ile | AUA | 116254 | 17.8 |
| Met | AUG | 136805 | 20.9 |
| Val | GUU | 144243 | 22.1 |
| Val | GUC | 76947 | 11.8 |
| Val | GUA | 76927 | 11.8 |
| Val | GUG | 70337 | 10.8 |
| Ser | UCU | 153557 | 23.5 |
| Ser | UCC | 92923 | 14.2 |
| Ser | UCA | 122028 | 18.7 |
| Ser | UCG | 55951 | 8.6 |
| Ser | AGU | 92466 | 14.2 |
| Ser | AGC | 63726 | 9.8 |
| Pro | CCU | 88263 | 13.5 |
| Pro | CCC | 44309 | 6.8 |
| Pro | CCA | 119641 | 18.3 |
| Pro | CCG | 34597 | 5.3 |
| Thr | ACU | 132522 | 20.3 |
| Thr | ACC | 83207 | 12.7 |
| Thr | ACA | 116084 | 17.8 |
| Thr | ACG | 52045 | 8.0 |
| Ala | GCU | 138358 | 21.2 |
| Ala | GCC | 82357 | 12.6 |
| Ala | GCA | 105910 | 16.2 |
| Ala | GCG | 40358 | 6.2 |
| Tyr | UAU | 122728 | 18.8 |
| Tyr | UAC | 96596 | 14.8 |

TABLE 2-continued

Codon Usage Table for *Saccharomyces cerevisiae* Genes

| Amino Acid | Codon | Number | Frequency per thousand |
|---|---|---|---|
| His | CAU | 89007 | 13.6 |
| His | CAC | 50785 | 7.8 |
| Gln | CAA | 178251 | 27.3 |
| Gln | CAG | 79121 | 12.1 |
| Asn | AAU | 233124 | 35.7 |
| Asn | AAC | 162199 | 24.8 |
| Lys | AAA | 273618 | 41.9 |
| Lys | AAG | 201361 | 30.8 |
| Asp | GAU | 245641 | 37.6 |
| Asp | GAC | 132048 | 20.2 |
| Glu | GAA | 297944 | 45.6 |
| Glu | GAG | 125717 | 19.2 |
| Cys | UGU | 52903 | 8.1 |
| Cys | UGC | 31095 | 4.8 |
| Trp | UGG | 67789 | 10.4 |
| Arg | CGU | 41791 | 6.4 |
| Arg | CGC | 16993 | 2.6 |
| Arg | CGA | 19562 | 3.0 |
| Arg | CGG | 11351 | 1.7 |
| Arg | AGA | 139081 | 21.3 |
| Arg | AGG | 60289 | 9.2 |
| Gly | GGU | 156109 | 23.9 |
| Gly | GGC | 63903 | 9.8 |
| Gly | GGA | 71216 | 10.9 |
| Gly | GGG | 39359 | 6.0 |
| Stop | UAA | 6913 | 1.1 |
| Stop | UAG | 3312 | 0.5 |
| Stop | UGA | 4447 | 0.7 |

By utilizing this or similar tables, one of ordinary skill in the art can apply the frequencies to any given polypeptide sequence, and produce a nucleic acid fragment of a codon-optimized coding region which encodes the polypeptide, but which uses codons optimal for a given species.

Randomly assigning codons at an optimized frequency to encode a given polypeptide sequence, can be done manually by calculating codon frequencies for each amino acid, and then assigning the codons to the polypeptide sequence randomly. Additionally, various algorithms and computer software programs are readily available to those of ordinary skill in the art. For example, the "EditSeq" function in the Lasergene Package, available from DNAstar, Inc., Madison, Wis., the backtranslation function in the Vector NTI Suite, available from InforMax, Inc., Bethesda, Md., and the "backtranslate" function in the GCG-Wisconsin Package, available from Accelrys, Inc., San Diego, Calif. In addition, various resources are publicly available to codon-optimize coding region sequences, e.g., the "backtranslation" function (Entelechon GmbH, Regensburg, Germany) and the "backtranseq" function (NRC Saskatoon Bioinformatics, Saskatoon, Saskatchewan, Canada). Constructing a rudimentary algorithm to assign codons based on a given frequency can also easily be accomplished with basic mathematical functions by one of ordinary skill in the art.

Codon-optimized coding regions can be designed by various methods known to those skilled in the art including software packages such as "synthetic gene designer" (University of Maryland, Baltimore, Md.).

As used herein, the term "polypeptide" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "protein," "amino acid chain," or any other term used to refer to a chain or chains of two or more amino acids, are included within the definition of "polypeptide," and the term "polypeptide" may be used instead of, or interchangeably with any of these terms. A polypeptide may be derived from a natural biological source or produced by recombinant technology, but is not necessarily translated from a designated nucleic acid sequence. It may be generated in any manner, including by chemical synthesis.

By an "isolated" polypeptide or a fragment, variant, or derivative thereof is intended a polypeptide that is not in its natural milieu. No particular level of purification is required. For example, an isolated polypeptide can be removed from its native or natural environment. Recombinantly produced polypeptides and proteins expressed in host cells are considered isolated for purposed of the invention, as are native or recombinant polypeptides which have been separated, fractionated, or partially or substantially purified by any suitable technique.

As used herein, the term "variant" refers to a polypeptide differing from a specifically recited polypeptide of the invention, such as DHAD, by amino acid insertions, deletions, mutations, and substitutions, created using, e.g., recombinant DNA techniques, such as mutagenesis. Guidance in determining which amino acid residues may be replaced, added, or deleted without abolishing activities of interest, may be found by comparing the sequence of the particular polypeptide with that of homologous polypeptides, e.g., yeast or bacterial, and minimizing the number of amino acid sequence changes made in regions of high homology (conserved regions) or by replacing amino acids with consensus sequences.

Alternatively, recombinant polynucleotide variants encoding these same or similar polypeptides may be synthesized or selected by making use of the "redundancy" in the genetic code. Various codon substitutions, such as silent changes which produce various restriction sites, may be introduced to optimize cloning into a plasmid or viral vector for expression. Mutations in the polynucleotide sequence may be reflected in the polypeptide or domains of other peptides added to the polypeptide to modify the properties of any part of the polypeptide. For example, mutations can be used to reduce or eliminate expression of a target protein and include, but are not limited to, deletion of the entire gene or a portion of the gene, inserting a DNA fragment into the gene (in either the promoter or coding region) so that the protein is not expressed or expressed at lower levels, introducing a mutation into the coding region which adds a stop codon or frame shift such that a functional protein is not expressed, and introducing one or more mutations into the coding region to alter amino acids so that a non-functional or a less enzymatically active protein is expressed.

Amino acid "substitutions" may be the result of replacing one amino acid with another amino acid having similar structural and/or chemical properties, i.e., conservative amino acid replacements, or they may be the result of replacing one amino acid with an amino acid having different structural and/or chemical properties, i.e., non-conservative amino acid replacements. "Conservative" amino acid substitutions may be made on the basis of similarity in polarity, charge, solubility, hydrophobicity, hydrophilicity, or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. Alternatively, "non-conservative" amino acid substitutions may be made by selecting the differences in polarity, charge, solubility, hydrophobicity, hydrophilicity, or the amphipathic nature of any of these amino acids. "Insertions" or "deletions" may be within the range of variation as structurally or functionally tolerated by the recombinant proteins. The variation allowed may be experimentally determined by systematically making insertions, deletions, or substitutions of amino acids in a polypeptide molecule using recombinant DNA techniques and assaying the resulting recombinant variants for activity.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Altschul, S. F., et al., *J. Mol. Biol.*, 215:403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular proteins. The skilled artisan, having the benefit of the sequences as reported herein, may now use all or a substantial portion of the disclosed sequences for purposes known to those skilled in this art. Accordingly, the instant invention comprises the complete sequences as reported in the accompanying Sequence Listing, as well as substantial portions of those sequences as defined above.

The term "complementary" is used to describe the relationship between nucleotide bases that are capable of hybridizing to one another. For example, with respect to DNA, adenine is complementary to thymine and cytosine is complementary to guanine, and with respect to RNA, adenine is complementary to uracil and cytosine is complementary to guanine.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: 1.) *Computational Molecular Biology* (Lesk, A. M., Ed.) Oxford University: NY (1988); 2.) *Biocomputing: Informatics and Genome Projects* (Smith, D. W., Ed.) Academic: NY (1993); 3.) *Computer Analysis of Sequence Data, Part I* (Griffin, A. M., and Griffin, H. G., Eds.) Humania: NJ (1994); 4.) *Sequence Analysis in Molecular Biology* (von Heinje, G., Ed.) Academic (1987); and 5.) *Sequence Analysis Primer* (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign™ program of the LASERGENE bioinformatics computing suite (DNASTAR Inc., Madison, Wis.). Multiple alignments of the sequences is performed using the "Clustal method of alignment" which encompasses several varieties of the algorithm including the "Clustal V method of alignment" corresponding to the alignment method labeled Clustal V (described by Higgins and Sharp, *CABIOS*. 5:151-153 (1989); Higgins, D. G. et al., *Comput. Appl. Biosci.*, 8:189-191 (1992)) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally the "Clustal W method of alignment" is available and corresponds to the alignment method labeled Clustal W (described by Higgins and Sharp, *CABIOS*. 5:151-153 (1989); Higgins, D. G. et al., *Comput. Appl. Biosci.* 8:189-191 (1992)) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs(%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides, from other species, wherein such polypeptides have the same or similar function or activity, or in describing the corresponding polynucleotides. Useful examples of percent identities include, but are not limited to: 55%, 60%, 65%, 70%, 75%, 80%, 85%, 90%, or 95%, or any integer percentage from 55% to 100% may be useful in describing the present invention, such as 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable polynucleotide fragments not only have the above homologies but typically comprise a polynucleotide having at least 50 nucleotides, at least 100 nucleotides, at least 150 nucleotides, at least 200 nucleotides, or at least 250 nucleotides. Further, suitable polynucleotide fragments having the above homologies encode a polypeptide having at least 50 amino acids, at least 100 amino acids, at least 150 amino acids, at least 200 amino acids, or at least 250 amino acids.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., *J. Mol. Biol.*, 215:403-410 (1990)); 3.) DNASTAR (DNASTAR, Inc. Madison, Wis.); 4.) SEQUENCHER (Gene Codes Corporation, Ann Arbor, Mich.); and 5.) the FASTA program incorporating the Smith-Waterman algorithm (W. R. Pearson, *Comput. Methods Genome Res.*, [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques used herein are well known in the art and are described by Sambrook, J., Fritsch, E. F. and Maniatis, T., *Molecular Cloning: A Laboratory Manual*, Second Edition, Cold Spring Harbor Laboratory Press, Cold Spring Harbor, N.Y. (1989) (hereinafter "Maniatis"); and by Silhavy, T. J., Bennan, M. L. and Enquist, L. W., *Experiments with Gene Fusions*, Cold Spring Harbor Laboratory Press, Cold Spring Harbor, N.Y. (1984); and by Ausubel, F. M. et al., *Current Protocols in Molecular Biology*, published by Greene Publishing Assoc. and Wiley-Interscience (1987).

The Functions of Fe—S Cluster-Requiring Proteins

The functions of proteins that contain Fe—S clusters are diverse. One of the more complete efforts to classify these functions is given in the following table which is adapted from Johnson, D. C., et al., *Structure, function, and formation of biological iron-sulfur clusters*. Annu Rev. Biochem., 2005. 74: p. 247-281.

TABLE 3

Functions of Biological [Fe—S] clusters[a].

| Function | Examples | Cluster type |
|---|---|---|
| Electron transfer | Ferredoxins; redox enzymes | [2Fe—2S]; [3Fe—4S]; [4Fe—4S] |
| Coupled electron/proton transfer | Rieske protein | [2Fe—2S] |
| | Nitrogenase | [8Fe—7S] |
| Substrate binding and activation | (de)Hydratases | [4Fe—4S], [2Fe—2S] |
| | Radical SAM enzymes | [4Fe—4S] |
| | Acetyl-CoA synthase | Ni—Ni—[4Fe—4S], [Ni—4Fe—5S] |
| | Sulfite reductase | [4Fe—4S]-siroheme |

TABLE 3-continued

Functions of Biological [Fe—S] clusters[a].

| Function | Examples | Cluster type |
|---|---|---|
| Fe or cluster storage | Ferredoxins | [4Fe—4S] |
| | Polyferredoxins | [4Fe—4S] |
| Structural | Endonuclease III | [4Fe—4S] |
| | MutY | [4Fe—4S] |
| Regulation of gene expression | SoxR | [2Fe—2S] |
| | FNR | [4Fe—4S]/[2Fe—2S] |
| | IRP | [4Fe—4S] |
| | IscR | [2Fe—2S] |
| Regulation of enzyme activity | Glutamine PRPP amidotransferase | [4Fe—4S] |
| | Ferrochelatase | [2Fe—2S] |
| Disulfide reduction | Ferredoxin: thioredoxin reductase | [4Fe—4S] |
| | Heterodisulfide reductase | [4Fe—4S] |
| Sulfur donor | Biotin synthase | [2Fe—2S] |

[a]Abbreviations used are SAM, S-adenosylmethionine; acetyl-CoA, acetyl coenzymeA; FNR, fumarate and nitrate reduction; IRP, iron-regulatory protein; IscR, iron-sulfur cluster assembly regulatory protein; PRPP, phosphoribosylpyrophosphate.

It is believed that an increase in the supply and the efficiency of loading Fe—S clusters into one or more of the members of the above classes will have commercial and/or medical benefits. Of the many possibilities that will be appreciated by the skilled artisan, three examples are given. 1) When an Fe—S cluster containing enzyme is used in a pathway to a fermentation product and needs to be expressed at high levels to maintain a high flux in the pathway to the product (e.g., dihydroxy-acid dehydratase in the pathway to isobutanol). 2) When an Fe—S cluster containing enzyme is used in a pathway to a fermentation product and the Fe—S cluster undergoes turnover during the catalysis (e.g., biotin synthase in the commercial fermentation of glucose to biotin). 3) In a diseased state such that the normal concentration of an Fe—S cluster containing protein important for good health is low (e.g., in cases of Friedreich's ataxia).

DHAD and DHAD Assays

DHAD is an Fe—S cluster requiring protein of the dehydratase (more properly hydro-lyase) class. A gene encoding a DHAD enzyme can be used to provide expression of DHAD activity in a recombinant host cell. DHAD catalyzes the conversion of 2,3-dihydroxyisovalerate to α-ketoisovalerate and of 2,3-dihydroxymethylvalerate to α-ketomethylvalerate and is classified as E.C. 4.2.1.9. Coding sequences for DHADs that are suitable for use in a recombinant host cell can be derived from bacterial, fungal, or plant sources. DHADs that may be used may have a [4Fe-4S] cluster or a [2Fe-2S]. Tables 4a, 4b, 5, and 6 list SEQ ID NOs for coding regions and proteins of representative DHADs that may be used in the present invention. Proteins with at least about 95% identity to certain listed sequences have been omitted for simplification, but it is understood that proteins, including those omitted for simplification, with at least about 95% sequence identity to any of the proteins listed in Tables 4a, 4b, 5, and 6 and having DHAD activity may be used as disclosed herein. Additional DHAD proteins and their encoding sequences may be identified by BLAST searching of public databases, as well known to one skilled in the art. Typically BLAST (described above) searching of publicly available databases with known DHAD sequences, such as those provided herein, is used to identify DHADs and their encoding sequences that may be expressed in the present cells. For example, DHAD proteins having amino acid sequence identities of at least about 80-85%, at least about 85-90%, at least about 90-95%, or at least about 98% sequence identity to any of the DHAD proteins of Table 3 may be expressed in the present cells. Identities are based on the Clustal W method of alignment using the default parameters of GAP PENALTY=10, GAP LENGTH PENALTY=0.1, and Gonnet 250 series of protein weight matrix.

TABLE 4a

SEQ ID NOs of Representative Bacterial [2Fe—2S] DHAD Proteins and Encoding Sequences.

| Organism of derivation | SEQ ID NO: Nucleic acid | SEQ ID NO: Peptide |
|---|---|---|
| Mycobacterium sp. MCS | 1 | 2 |
| Mycobacterium gilvum PYR-GCK | 3 | 4 |
| Mycobacterium smegmatis str. MC2 155 | 5 | 6 |
| Mycobacterium vanbaalenii PYR-1 | 7 | 8 |
| Nocardia farcinica IFM 10152 | 9 | 10 |
| Rhodococcus sp. RHA1 | 11 | 12 |
| Mycobacterium ulcerans Agy99 | 13 | 14 |
| Mycobacterium avium subsp. paratuberculosis K-10 | 15 | 16 |
| Mycobacterium tuberculosis H37Ra | 17 | 18 |
| Mycobacterium leprae TN * | 19 | 20 |
| Kineococcus radiotolerans SRS30216 | 21 | 22 |
| Janibacter sp. HTCC2649 | 23 | 24 |
| Nocardioides sp. JS614 | 25 | 26 |
| Renibacterium salmoninarum ATCC 33209 | 27 | 28 |
| Arthrobacter aurescens TC1 | 29 | 30 |
| Leifsonia xyli subsp. xyli str. CTCB07 | 31 | 32 |
| marine actinobacterium PHSC20C1 | 33 | 34 |
| Clavibacter michiganensis subsp. michiganensis NCPPB 382 | 35 | 36 |
| Saccharopolyspora erythraea NRRL 2338 | 37 | 38 |
| Acidothermus cellulolyticus 11B | 39 | 40 |
| Corynebacterium efficiens YS-314 | 41 | 42 |
| Brevibacterium linens BL2 | 43 | 44 |
| Tropheryma whipplei TW08/27 | 45 | 46 |
| Methylobacterium extorquens PA1 | 47 | 48 |
| Methylobacterium nodulans ORS 2060 | 49 | 50 |
| Rhodopseudomonas palustris BisB5 | 51 | 52 |
| Rhodopseudomonas palustris BisB18 | 53 | 54 |
| Bradyrhizobium sp. ORS278 | 55 | 56 |
| Bradyrhizobium japonicum USDA 110 | 57 | 58 |
| Fulvimarina pelagi HTCC2506 | 59 | 60 |
| Aurantimonas sp. SI85-9A1 | 61 | 62 |
| Hoeflea phototrophica DFL-43 | 63 | 64 |
| Mesorhizobium loti MAFF303099 | 65 | 66 |
| Mesorhizobium sp. BNC1 | 67 | 68 |
| Parvibaculum lavamentivorans DS-1 | 69 | 70 |
| Loktanella vestfoldensis SKA53 | 71 | 72 |
| Roseobacter sp. CCS2 | 73 | 74 |

TABLE 4a-continued

SEQ ID NOs of Representative Bacterial [2Fe—2S] DHAD Proteins and Encoding Sequences.

| Organism of derivation | SEQ ID NO: Nucleic acid | SEQ ID NO: Peptide |
|---|---|---|
| Dinoroseobacter shibae DFL 12 | 75 | 76 |
| Roseovarius nubinhibens ISM | 77 | 78 |
| Sagittula stellata E-37 | 79 | 80 |
| Roseobacter sp. AzwK-3b | 81 | 82 |
| Roseovarius sp. TM1035 | 83 | 84 |
| Oceanicola batsensis HTCC2597 | 85 | 86 |
| Oceanicola granulosus HTCC2516 | 87 | 88 |
| Rhodobacterales bacterium HTCC2150 | 89 | 90 |
| Paracoccus denitrificans PD1222 | 91 | 92 |
| Oceanibulbus indolifex HEL-45 | 93 | 94 |
| Sulfitobacter sp. EE-36 | 95 | 96 |
| Roseobacter denitrificans OCh 114 | 97 | 98 |
| Jannaschia sp. CCS1 | 99 | 100 |
| Caulobacter sp. K31 | 101 | 102 |
| Candidatus Pelagibacter ubique HTCC1062 | 103 | 104 |
| Erythrobacter litoralis HTCC2594 | 105 | 106 |
| Erythrobacter sp. NAP1 | 107 | 108 |
| Comamonas testosterone KF-1 | 109 | 110 |
| Sphingomonas wittichii RW1 | 111 | 112 |
| Burkholderia xenovorans LB400 | 113 | 114 |
| Burkholderia phytofirmans PsJN | 115 | 116 |
| Bordetella petrii DSM 12804 | 117 | 118 |
| Bordetella bronchiseptica RB50 | 119 | 120 |
| Bradyrhizobium sp. ORS278 | 121 | 122 |
| Bradyrhizobium sp. BTAi1 | 123 | 124 |
| Bradhyrhizobium japonicum | 125 | 126 |
| Sphingomonas wittichii RW1 | 127 | 128 |
| Rhodobacterales bacterium HTCC2654 | 129 | 130 |
| Solibacter usitatus Ellin6076 | 131 | 132 |
| Roseiflexus sp. RS-1 | 133 | 134 |
| Rubrobacter xylanophilus DSM 9941 | 135 | 136 |
| Salinispora tropica CNB-440 | 137 | 138 |
| Acidobacteria bacterium Ellin345 | 139 | 140 |
| Thermus thermophilus HB27 | 141 | 142 |
| Maricaulis maris MCS10 | 143 | 144 |
| Parvularcula bermudensis HTCC2503 | 145 | 146 |
| Oceanicaulis alexandrii HTCC2633 | 147 | 148 |
| Plesiocystis pacifica SIR-1 | 149 | 150 |
| Bacillus sp. NRRL B-14911 | 151 | 152 |
| Oceanobacillus iheyensis HTE831 | 153 | 154 |
| Staphylococcus saprophyticus subsp. saprophyticus ATCC 15305 | 155 | 156 |
| Bacillus selenitireducens MLS10 | 157 | 158 |
| Streptococcus pneumoniae SP6-BS73 | 159 | 160 |
| Streptococcus sanguinis SK36 | 161 | 162 |
| Streptococcus thermophilus LMG 18311 | 163 | 164 |
| Streptococcus suis 89/1591 | 165 | 166 |
| Streptococcus mutans UA159 | 167 | 168 |
| Leptospira borgpetersenii serovar Hardjo-bovis L550 | 169 | 170 |
| Candidatus Vesicomyosocius okutanii HA | 171 | 172 |
| Candidatus Ruthia magnifica str. Cm (Calyptogena magnifica) | 173 | 174 |
| Methylococcus capsulatus str. Bath | 175 | 176 |
| uncultured marine bacterium EB80_02D08 | 177 | 178 |
| uncultured marine gamma proteobacterium EBAC31A08 | 179 | 180 |
| uncultured marine gamma proteobacterium EBAC20E09 | 181 | 182 |
| uncultured gamma proteobacterium eBACHOT4E07 | 183 | 184 |
| Alcanivorax borkumensis SK2 | 185 | 186 |
| Chromohalobacter salexigens DSM 3043 | 187 | 188 |
| Marinobacter algicola DG893 | 189 | 190 |
| Marinobacter aquaeolei VT8 | 191 | 192 |
| Marinobacter sp. ELB17 | 193 | 194 |
| Pseudoalteromonas haloplanktis TAC125 | 195 | 196 |
| Acinetobacter sp. ADP1 | 197 | 198 |
| Opitutaceae bacterium TAV2 | 199 | 200 |
| Flavobacterium sp. MED217 | 201 | 202 |
| Cellulophaga sp. MED134 | 203 | 204 |
| Kordia algicida OT-1 | 205 | 206 |
| Flavobacteriales bacterium ALC-1 | 207 | 208 |
| Psychroflexus torquis ATCC 700755 | 209 | 210 |
| Flavobacteriales bacterium HTCC2170 | 211 | 212 |
| unidentified eubacterium SCB49 | 213 | 214 |
| Gramella forsetii KT0803 | 215 | 216 |
| Robiginitalea biformata HTCC2501 | 217 | 218 |
| Tenacibaculum sp. MED152 | 219 | 220 |
| Polaribacter irgensii 23-P | 221 | 222 |
| Pedobacter sp. BAL39 | 223 | 224 |
| Flavobacteria bacterium BAL38 | 225 | 226 |
| Flavobacterium psychrophilum JIP02/86 | 227 | 228 |
| Flavobacterium johnsoniae UW101 | 229 | 230 |
| Lactococcus lactis subsp. cremoris SK11 | 231 | 232 |
| Psychromonas ingrahamii 37 | 233 | 234 |
| Microscilla marina ATCC 23134 | 235 | 236 |
| Cytophaga hutchinsonii ATCC 33406 | 237 | 238 |
| Rhodopirellula baltica SH 1 | 239 | 240 |
| Blastopirellula marina DSM 3645 | 241 | 242 |
| Planctomyces maris DSM 8797 | 243 | 244 |
| Algoriphagus sp. PR1 | 245 | 246 |
| Candidatus Sulcia muelleri str. Hc (Homalodisca coagulata) | 247 | 248 |
| Candidatus Carsonella ruddii PV | 249 | 250 |
| Synechococcus sp. RS9916 | 251 | 252 |
| Synechococcus sp. WH 7803 | 253 | 254 |
| Synechococcus sp. CC9311 | 255 | 256 |
| Synechococcus sp. CC9605 | 257 | 258 |
| Synechococcus sp. WH 8102 | 259 | 260 |
| Synechococcus sp. BL107 | 261 | 262 |
| Synechococcus sp. RCC307 | 263 | 264 |
| Synechococcus sp. RS9917 | 265 | 266 |
| Synechococcus sp. WH 5701 | 267 | 268 |
| Prochlorococcus marinus str. MIT 9313 | 269 | 270 |
| Prochlorococcus marinus str. NATL2A | 271 | 272 |
| Prochlorococcus marinus str. MIT 9215 | 273 | 274 |
| Prochlorococcus marinus str. AS9601 | 275 | 276 |
| Prochlorococcus marinus str. MIT 9515 | 277 | 278 |
| Prochlorococcus marinus subsp. pastoris str. CCMP1986 | 279 | 280 |
| Prochlorococcus marinus str. MIT 9211 | 281 | 282 |
| Prochlorococcus marinus subsp. marinus str. CCMP1375 | 283 | 284 |
| Nodularia spumigena CCY9414 | 285 | 286 |
| Nostoc punctiforme PCC 73102 | 287 | 288 |
| Nostoc sp. PCC 7120 | 289 | 290 |
| Trichodesmium erythraeum IMS101 | 291 | 292 |
| Acaryochloris marina MBIC11017 | 293 | 294 |
| Lyngbya sp. PCC 8106 | 295 | 296 |
| Synechocystis sp. PCC 6803 | 297 | 298 |
| Cyanothece sp. CCY0110 | 299 | 300 |
| Thermosynechococcus elongatus BP-1 | 301 | 302 |
| Synechococcus sp. JA-2-3B'a(2-13) | 303 | 304 |
| Gloeobacter violaceus PCC 7421 | 305 | 306 |
| Nitrosomonas eutropha C91 | 307 | 308 |
| Nitrosomonas europaea ATCC 19718 | 309 | 310 |
| Nitrosospira multiformis ATCC 25196 | 311 | 312 |
| Chloroflexus aggregans DSM 9485 | 313 | 314 |
| Leptospirillum sp. Group II UBA | 315 | 316 |
| Leptospirillum sp. Group II UBA | 317 | 318 |
| Halorhodospira halophila SL1 | 319 | 320 |
| Nitrococcus mobilis Nb-231 | 321 | 322 |
| Alkalilimnicola ehrlichei MLHE-1 | 323 | 324 |
| Deinococcus geothermalis DSM 11300 | 325 | 326 |
| Polynucleobacter sp. QLW-P1DMWA-1 | 327 | 328 |
| Polynucleobacter necessarius STIR1 | 329 | 330 |
| Azoarcus sp. EbN1 | 331 | 332 |
| Burkholderia phymatum STM815 | 333 | 334 |
| Burkholderia xenovorans LB400 | 335 | 336 |
| Burkholderia multivorans ATCC 17616 | 337 | 338 |
| Burkholderia cenocepacia PC184 | 339 | 340 |
| Burkholderia mallei GB8 horse 4 | 341 | 342 |
| Ralstonia eutropha JMP134 | 343 | 344 |
| Ralstonia metallidurans CH34 | 345 | 346 |
| Ralstonia solanacearum UW551 | 347 | 348 |

TABLE 4a-continued

SEQ ID NOs of Representative Bacterial [2Fe—2S] DHAD Proteins and Encoding Sequences.

| Organism of derivation | SEQ ID NO: Nucleic acid | SEQ ID NO: Peptide |
|---|---|---|
| Ralstonia pickettii 12J | 349 | 350 |
| Limnobacter sp. MED105 | 351 | 352 |
| Herminiimonas arsenicoxydans | 353 | 354 |
| Bordetella parapertussis | 355 | 356 |
| Bordetella petrii DSM 12804 | 357 | 358 |
| Polaromonas sp. JS666 | 359 | 360 |
| Polaromonas naphthalenivorans CJ2 | 361 | 362 |
| Rhodoferax ferrireducens T118 | 363 | 364 |
| Verminephrobacter eiseniae EF01-2 | 365 | 366 |
| Acidovorax sp. JS42 | 367 | 368 |
| Delftia acidovorans SPH-1 | 369 | 370 |
| Methylibium petroleiphilum PM1 | 371 | 372 |
| gamma proteobacterium KT 71 | 373 | 374 |
| Tremblaya princes | 375 | 376 |
| Blastopirellula marina DSM 3645 | 377 | 378 |
| Planctomyces maris DSM 8797 | 379 | 380 |
| Microcystis aeruginosa PCC 7806 | 381 | 382 |
| Salinibacter ruber DSM 13855 | 383 | 384 |
| Methylobacterium chloromethanicum | 385 | 386 |

TABLE 4b

Additional representative bacterial [2Fe—2S] DHAD proteins and encoding sequences.

| Organism of derivation | Nucleic acid SEQ ID NO: | Amino acid SEQ ID NO: |
|---|---|---|
| Burkholderia ambifaria AMMD | 387 | 388 |
| Bradyrhizobium sp. BTAi1 | 389 | 390 |
| Delftia acidovorans SPH-1 | 391 | 392 |
| Microcystis aeruginosa NIES-843 | 393 | 394 |
| uncultured marine microorganism HF4000_APKG8C21 | 395 | 396 |
| Burkholderia ubonensis Bu | 397 | 398 |
| Gemmata obscuriglobus UQM 2246 | 399 | 400 |
| Mycobacterium abscessus | 401 | 402 |
| Synechococcus sp. PCC 7002 | 403 | 404 |
| Burkholderia graminis C4D1M | 405 | 406 |
| Methylobacterium radiotolerans JCM 2831 | 407 | 408 |
| Leptothrix cholodnii SP-6 | 409 | 410 |
| Verrucomicrobium spinosum DSM 4136 | 411 | 412 |
| Cyanothece sp. ATCC 51142 | 413 | 414 |
| Opitutus terrae PB90-1 | 415 | 416 |
| Leptospira biflexa serovar Patoc strain 'Patoc 1 (Paris)' | 417 | 418 |
| Methylacidiphilum infernorum V4 | 419 | 420 |
| Cupriavidus taiwanensis | 421 | 422 |
| Chthoniobacter flavus Ellin428 | 423 | 424 |
| Cyanothece sp. PCC 7822 | 425 | 426 |
| Phenylobacterium zucineum HLK1 | 427 | 428 |
| Leptospirillum sp. Group II '5-way CG' | 429 | 430 |
| Arthrospira maxima CS-328 | 431 | 432 |
| Oligotropha carboxidovorans OM5 | 433 | 434 |
| Rhodospirillum centenum SW | 435 | 436 |
| Cyanothece sp. PCC 8801 | 437 | 438 |
| Thermus aquaticus Y51MC23 | 439 | 440 |
| Cyanothece sp. PCC 7424 | 441 | 442 |
| Acidithiobacillus ferrooxidans ATCC 23270 | 443 | 444 |
| Cyanothece sp. PCC 7425 | 445 | 446 |
| Arthrobacter chlorophenolicus A6 | 447 | 448 |
| Burkholderia multivorans CGD2M | 449 | 450 |
| Thermomicrobium roseum DSM 5159 | 451 | 452 |
| bacterium Ellin514 | 453 | 454 |
| Desulfobacterium autotrophicum HRM2 | 455 | 456 |
| Thioalkalivibrio sp. K90mix | 457 | 458 |
| Flavobacteria bacterium MS024-3C | 459 | 460 |
| Flavobacteria bacterium MS024-2A | 461 | 462 |
| 'Nostoc azollae' 0708 | 463 | 464 |

TABLE 4b-continued

Additional representative bacterial [2Fe—2S] DHAD proteins and encoding sequences.

| Organism of derivation | Nucleic acid SEQ ID NO: | Amino acid SEQ ID NO: |
|---|---|---|
| Acidobacterium capsulatum ATCC 51196 | 465 | 466 |
| Gemmatimonas aurantiaca T-27 | 467 | 468 |
| Gemmatimonas aurantiaca T-27 | 469 | 470 |
| Rhodococcus erythropolis PR4 | 471 | 472 |
| Deinococcus deserti VCD115 | 473 | 474 |
| Rhodococcus opacus B4 | 475 | 476 |
| Chryseobacterium gleum ATCC 35910 | 477 | 478 |
| Thermobaculum terrenum ATCC BAA-798 | 479 | 480 |
| Kribbella flavida DSM 17836 | 481 | 482 |
| Gordonia bronchialis DSM 43247 | 483 | 484 |
| Geodermatophilus obscurus DSM 43160 | 485 | 486 |
| Xylanimonas cellulosilytica DSM 15894 | 487 | 488 |
| Sphingobacterium spiritivorum ATCC 33300 | 489 | 490 |
| Meiothermus silvanus DSM 9946 | 491 | 492 |
| Meiothermus ruber DSM 1279 | 493 | 494 |
| Nakamurella multipartita DSM 44233 | 495 | 496 |
| Cellulomonas flavigena DSM 20109 | 497 | 498 |
| Rhodothermus marinus DSM 4252 | 499 | 500 |
| Planctomyces limnophilus DSM 3776 | 501 | 502 |
| Beutenbergia cavernae DSM 12333 | 503 | 504 |
| Spirosoma linguale DSM 74 | 505 | 506 |
| Sphaerobacter thermophilus DSM 20745 | 507 | 508 |
| Lactococcus lactis | 509 | 510 |
| Thermus thermophilus HB8 | 511 | 512 |
| Anabaena variabilis ATCC 29413 | 513 | 514 |
| Roseovarius sp. 217 | 515 | 516 |
| uncultured Prochlorococcus marinus clone HF10-88D1 | 517 | 518 |
| Burkholderia xenovorans LB400 | 519 | 520 |
| Saccharomonospora viridis DSM 43017 | 521 | 522 |
| Pedobacter heparinus DSM 2366 | 523 | 524 |
| Microcoleus chthonoplastes PCC 7420 | 525 | 526 |
| Acidimicrobium ferrooxidans DSM 10331 | 527 | 528 |
| Rhodobacterales bacterium HTCC2083 | 529 | 530 |
| Candidatus Pelagibacter sp. HTCC7211 | 531 | 532 |
| Chitinophaga pinensis DSM 2588 | 533 | 534 |
| Alcanivorax sp. DG881 | 535 | 536 |
| Micrococcus luteus NCTC 2665 | 537 | 538 |
| Verrucomicrobiae bacterium DG1235 | 539 | 540 |
| Synechococcus sp. PCC 7335 | 541 | 542 |
| Brevundimonas sp. BAL3 | 543 | 544 |
| Dyadobacter fermentans DSM 18053 | 545 | 546 |
| gamma proteobacterium NOR5-3 | 547 | 548 |
| gamma proteobacterium NOR51-B | 549 | 550 |
| Cyanobium sp. PCC 7001 | 551 | 552 |
| Jonesia denitrificans DSM 20603 | 553 | 554 |
| Brachybacterium faecium DSM 4810 | 555 | 556 |
| Paenibacillus sp. JDR-2 | 557 | 558 |
| Octadecabacter antarcticus 307 | 559 | 560 |
| Variovorax paradoxus S110 | 561 | 562 |

TABLE 5

SEQ ID NOs of Representative Fungal and Plant [2Fe—2S] DHAD Proteins and Encoding Sequences.

| Description | SEQ ID NO: Nucleic acid | SEQ ID NO: Peptide |
|---|---|---|
| Schizosaccharomyces pombe ILV3 | 5563 | 564 |
| Saccharomyces cerevisiae ILV3 | 5565 | 566 |
| Kluyveromyces lactis ILV3 | 5567 | 568 |
| Candida albicans SC5314 ILV3 | 5569 | 570 |
| Pichia stipitis CBS 6054 ILV3 | 5571 | 572 |
| Yarrowia lipolytica ILV3 | 5573 | 574 |
| Candida galbrata CBS 138 ILV3 | 5575 | 576 |
| Chlamydomonas reinhardtii | 5577 | 578 |
| Ostreococcus lucimarinus CCE9901 | 5579 | 580 |
| Vitis vinifera | 5581 | 582 |

TABLE 5-continued

SEQ ID NOs of Representative Fungal and Plant [2Fe—2S] DHAD Proteins and Encoding Sequences.

| Description | SEQ ID NO: Nucleic acid | SEQ ID NO: Peptide |
|---|---|---|
| (Unnamed protein product: CAO71581.1) | | |
| Vitis vinifera | 5583 | 584 |
| (Hypothetical protein: CAN67446.1) | | |
| Arabidopsis thaliana | 5585 | 586 |
| Oryza sativa (indica cultivar-group) | 5587 | 588 |
| Physcomitrella patens subsp. Patens | 5589 | 590 |
| Chaetomium globosum CBS 148.51 | 5591 | 592 |
| Neurospora crassa OR74A | 5593 | 594 |
| Magnaporthe grisea 70-15 | 5595 | 596 |
| Gibberella zeae PH-1 | 5597 | 598 |
| Aspergillus niger | 5599 | 600 |
| Neosartorya fischeri NRRL 181 (XP_001266525.1) | 6601 | 602 |
| Neosartorya fischeri NRRL 181 (XP_001262996.1) | 6603 | 604 |
| Aspergillus niger (hypothetical protein An03g04520) | 6605 | 606 |
| Aspergillus niger (Hypothetical protein An14g03280) | 6607 | 608 |
| Aspergillus terreus NIH2624 | 6609 | 610 |
| Aspergillus clavatus NRRL 1 | 6611 | 612 |
| Aspergillus nidulans FGSC A4 | 6613 | 614 |
| Aspergillus oryzae | 6615 | 616 |
| Ajellomyces capsulatus NAm1 | 6617 | 618 |
| Coccidioides immitis RS | 6619 | 620 |
| Botryotinia fuckeliana B05.10 | 6621 | 622 |
| Phaeosphaeria nodorum SN15 | 6623 | 624 |
| Pichia guilliermondii ATCC 6260 | 6625 | 626 |
| Debaryomyces hansenii CBS767 | 6627 | 628 |
| Lodderomyces elongisporus NRRL YB-4239 | 6629 | 630 |
| Vanderwaltozyma polyspora DSM 70294 | 6631 | 632 |
| Ashbya gossypii ATCC 10895 | 6633 | 634 |
| Laccaria bicolor S238N-H82 | 6635 | 636 |
| Coprinopsis cinerea okayama7#130 | 6637 | 638 |
| Cryptococcus neoformans var. neoformans JEC21 | 6639 | 640 |
| Ustilago maydis 521 | 6641 | 642 |
| Malassezia globosa CBS 7966 | 6643 | 644 |
| Aspergillus clavatus NRRL 1 | 6645 | 646 |
| Neosartorya fischeri NRRL 181 (Putative) | 6647 | 648 |
| Aspergillus oryzae | 6649 | 650 |
| Aspergillus niger (hypothetical protein An18g04160) | 6651 | 652 |
| Aspergillus terreus NIH2624 | 6653 | 654 |
| Coccidioides immitis RS (hypothetical protein CIMG_04591) | 6655 | 656 |
| Paracoccidioides brasiliensis | 6657 | 658 |
| Phaeosphaeria nodorum SN15 | 6659 | 660 |
| Gibberella zeae PH-1 | 6661 | 662 |
| Neurospora crassa OR74A | 6663 | 664 |
| Coprinopsis cinerea okayama 7#130 | 6665 | 666 |
| Laccaria bicolor S238N-H82 | 6667 | 668 |
| Ustilago maydis 521 | 6669 | 670 |

TABLE 6

SEQ ID NOs of Representative [4Fe—4S] DHAD Proteins and Encoding Sequences.

| Organism | SEQ ID NO: Nucleic acid | SEQ ID NO: Peptide |
|---|---|---|
| Escherichia coli str. K-12 substr. MG1655 | 671 | 672 |
| Bacillus subtilis subsp. subtilis str. 168 | 673 | 674 |
| Agrobacterium tumefaciens str. C58 | 675 | 676 |
| Burkholderia cenocepacia MC0-3 | 677 | 678 |
| Psychrobacter cryohalolentis K5 | 679 | 680 |
| Psychromonas sp. CNPT3 | 681 | 682 |
| Deinococcus radiodurans R1 | 683 | 684 |
| Wolinella succinogenes DSM 1740 | 685 | 686 |
| Zymomonas mobilis subsp. mobilis ZM4 | 687 | 688 |
| Clostridium acetobutylicum ATCC 824 | 689 | 690 |
| Clostridium beijerinckii NCIMB 8052 | 691 | 692 |
| Pseudomonas fluorescens Pf-5 | 693 | 694 |
| Methanococcus maripaludis C7 | 695 | 696 |
| Methanococcus aeolicus Nankai-3 | 697 | 698 |
| Vibrio fischeri ATCC 700601 (ES114) | 699 | 700 |
| Shewanella oneidensis MR-1 ATCC 700550 | 701 | 702 |

Additional [2Fe-2S] DHADs may be identified using the analysis described in U.S. patent application Ser. No. 12/569,636, filed Sep. 29, 2009, which is herein incorporated by reference. The analysis is as follows: A Profile Hidden Markov Model (HMM) was prepared based on amino acid sequences of eight functionally verified DHADs. The application of Profile HMM has been described. See, e.g., Krogh et al., *J. Mol. Biol.* 235:1501-1531 (1994) and Durbin et al., "Markov chains and hidden Markov models," in Biological Sequence Analysis: Probabilistic Models of Proteins and Nucleic Acids, Cambridge University Press (1998). A Profile HMM is a statistical model built of multiple sequence alignments that can be used to determine whether or not a test sequence belongs to a particular family of sequences. See id. A Profile HMM can be built by first generating an alignment of functionally verified sequences using conventional sequence alignment tools. Next, the sequence alignment is used to build the Profile HMM using publicly available software programs (e.g., HMMER) that use a position-specific scoring system to capture information about the degree of conservation at various amino acid positions in the multiple alignment of the input sequences. More specifically, the scores of amino acid residues in a "match" state (i.e., match state emission scores), or in an "insert" state (i.e., insert state emission scores) are captured which are proportional to the expression: $\text{Log\_2 }(p\_x)/(null\_x)$. See id. In this expression, the term "p_x" is the probability of an amino acid residue, at a particular position in the alignment, according to the Profile HMM, and the term "null_x" is the probability according to the Null model. See id. The Null model is a simple one state probabilistic model with a pre-calculated set of emission probabilities for each of the amino acids derived from the distribution of amino acids. See id. "State" transition scores are also calculated as log odds parameters and are proportional to $\text{Log\_2 }(t\_x)$. See id. In this expression, the term "t_x" is the probability of transiting to an emitter or non-emitter state. See id. Further details regarding the particular statistical analyses to generate a Profile HMM are available in Krogh et al., *J. Mol. Biol.* 235:1501-1531 (1994) and Durbin et al., "Markov chains and hidden Markov models," in Biological Sequence Analysis: Probabilistic Models of Proteins and Nucleic Acids, Cambridge University Press (1998), and U.S. patent application Ser. No. 12/569,636.

A Profile Hidden Markov Model (HMM) was prepared based on amino acid sequences of eight functionally verified DHADs are from *Nitrosomonas europaea* (DNA SEQ ID NO:309; protein SEQ ID NO:310), *Synechocystis* sp. PCC6803 (DNA SEQ ID:297; protein SEQ ID NO:298), *Streptococcus mutans* (DNA SEQ ID NO:167; protein SEQ ID NO:168), *Streptococcus thermophilus* (DNA SEQ ID NO:163; SEQ ID No:164), *Ralstonia metallidurans* (DNA SEQ ID NO:345; protein SEQ ID NO:346), *Ralstonia eutropha* (DNA SEQ ID NO:343; protein SEQ ID NO:344), and *Lactococcus lactis* (DNA SEQ ID NO:231; protein SEQ ID NO:232). In addition the DHAD from *Flavobacterium johnsoniae* (DNA SEQ ID NO:229; protein SEQ ID NO:230) was found to have dihydroxy-acid dehydratase activity when expressed in *E. coli* and was used in making the Profile. The Profile HMM is prepared using the HMMER software package (The theory behind profile HMMs is described in R. Durbin, S. Eddy, A. Krogh, and G. Mitchison, Biological sequence analysis: probabilistic models of proteins and nucleic acids, Cambridge University Press, 1998; Krogh et al., 1994; J. Mol. Biol. 235:1501-1531), following the user guide which is available from HMMER (Janelia Farm Research Campus, Ashburn, Va.). The output of the HMMER software program is a Profile Hidden Markov Model (HMM) that characterizes the input sequences. The Profile HMM prepared for the eight DHAD proteins is given in U.S. application Ser. No. 12/569,636, filed Sep. 29, 2009 and in Table 12.

The first line in Table 12 for each position reports the probability for each amino acid to be in that "state" (match state emission scores). The second line reports the insert state emission scores, and the third line reports the state transition scores. The highest probability is highlighted for each position. These scores can be converted into "E values" (expectation values), which are the number of hits or matches to the Profile HMM one would expect to obtain just by chance. A protein having an E value of $<10^{-5}$ match to the Profile HMM, indicates that the protein shares significant sequence similarity with the seed proteins used to construct the Profile HMM and that the protein belongs to the family represented by the profile HMM.

Any protein that matches the Profile HMM with an E value of $<10^{-5}$ is a DHAD related protein, which includes [4Fe-4S] DHADs, [2Fe-2S] DHADs, arabonate dehydratases, and phosphogluconate dehydratases. In embodiments, sequences matching the Profile HMM are then analyzed for the presence of the three conserved cysteines, corresponding to positions 56, 129, and 201 in the *Streptococcus mutans* DHAD. The presence of all three conserved cysteines is characteristic of proteins having a [2Fe-2S] cluster. Proteins having the three conserved cysteines include arabonate dehydratases and [2Fe-2S] DHADs. The [2Fe-2S] DHADs may be distinguished from the arabonate dehydratases by analyzing for signature conserved amino acids found to be present in the [2Fe-2S] DHADs or in the arabonate dehydratases at positions corresponding to the following positions in the *Streptococcus mutans* DHAD amino acid sequence. These signature amino acids are in [2Fe-2S] DHADs or in arabonate dehydratases, respectively, at the following positions (with greater than 90% occurance): 88 asparagine vs. glutamic acid; 113 not conserved vs. glutamic acid; 142 arginine or asparagine vs. not conserved; 165 not conserved vs. glycine; 208 asparagine vs. not conserved; 454 leucine vs. not conserved; 477 phenylalanine or tyrosine vs. not conserved; and 487 glycine vs. not conserved.

Additionally, the sequences of DHAD coding regions provided herein may be used to identify other homologs in nature. Such methods are well-known in the art, and various methods that may be used to isolate genes encoding homologous proteins are described in U.S. application Ser. No. 12/569,636, filed Sep. 29, 2009, which such methods are incorporated by reference herein.

The presence of DHAD activity in a cell engineered to express a heterologous DHAD can be confirmed using methods known in the art. As one example, and as demonstrated in the Examples herein, crude extracts from cells engineered to express a bacterial DHAD may be used in a DHAD assay as described by Flint and Emptage (*J. Biol. Chem.* (1988) 263 (8): 3558-64) using dinitrophenylhydrazine. In another example, DHAD activity may be assayed by expressing a heterologous DHAD identifiable by the methods disclosed herein in a yeast strain that lacks endogenous DHAD activity. If DHAD activity is present, the yeast strain will grow in the absence of branched-chain amino acids. DHAD activity may also be confirmed by more indirect methods, such as by assaying for a downstream product in a pathway requiring DHAD activity. Any product that has α-ketoisovalerate or α-ketomethylvalerate as a pathway intermediate may be measured in an assay for DHAD activity. A list of such products includes, but is not limited to, valine, isoleucine, leucine, pantothenic acid, 2-methyl-1-butanol, 3-methyl-1-butanol, and isobutanol.

Over-Expression of DHAD Activity

Applicants have found that expression of a heterologous DHAD can provide DHAD activity when expressed in a host cell. Expression of a DHAD which may be identified as described herein can provide DHAD activity for a biosynthetic pathway that includes conversion of 2,3-dihydroxyisovalerate to α-ketoisovalerate or 2,3-dihydroxymethylvalerate to α-ketomethylvalerate. In addition, the *S. mutans* [2Fe-2S] DHAD was shown in related U.S. application Ser. No. 12/569,636, filed Sep. 29, 2009, incorporated by reference herein, to have higher stability in air as compared to the sensitivity in air of the *E. coli* [4Fe-4S] DHAD, which is desirable for obtaining better activity in a heterologous host cell.

Furthermore, as described herein, it has been found that expressing a heterologous DHAD protein at higher levels can provide increased DHAD activity when expressed in a host cell. High expression of a recombinant polynucleotide can be accomplished in at least two ways: 1) by increasing the copy number of a plasmid comprising the recombinant polynucleotide; or 2) by integrating multiple copies of the gene of interest into the host cell's chromosome. As exemplified herein, expression of multiple copies of the heterologous DHAD, provides an increase in specific activity of heterologous DHAD Recombinant polynucleotides are typically cloned for expression using the coding sequence as part of a chimeric gene used for transformation, which includes a promoter operably linked to the coding sequence as well as a ribosome binding site and a termination control region. The coding region may be from the host cell for transformation and combined with regulatory sequences that are not native to the natural gene encoding DHAD. Alternatively, the coding region may be from another host cell.

Vectors useful for the transformation of a variety of host cells are common and described in the literature. Typically the vector contains a selectable marker and sequences allowing autonomous replication or chromosomal integration in the desired host. In addition, suitable vectors may comprise a promoter region which harbors transcriptional initiation controls and a transcriptional termination control region, between which a coding region DNA fragment may be inserted, to provide expression of the inserted coding region. Both control regions may be derived from genes homologous to the transformed host cell, although it is to be understood that such control regions may also be derived from genes that are not native to the specific species chosen as a production host.

Yeast cells that can be hosts for expression or over-expression of a heterologous bacterial DHAD are any yeast cells that are amenable to genetic manipulation and include, but are not limited to, *Saccharomyces, Schizosaccharomyces, Hansenula, Candida, Kluyveromyces, Yarrowia, Issatchenkia*, and *Pichia*. Suitable strains include, but are not limited to, *Saccharomyces cerevisiae, Schizosaccharomyces pombe, Kluyveromyces lactis, Kluyveromyces thermotolerans, Candida glabrata, Candida albicans, Pichia stipitis* and *Yarrowia lipolytica*. In one embodiment, the host is *Saccharomyces cerevisiae*.

Expression is achieved by transforming a host cell with a gene comprising a sequence encoding DHAD, for example, a DHAD listed in Tables 4a, 4b, 5 or 6, or identified using the screening methods in related U.S. application Ser. No. 12/569,636, filed Sep. 29, 2009, incorporated by reference herein. The coding region for the DHAD to be expressed may be codon optimized for the target host cell, as well known to one skilled in the art. Methods for gene expression in yeast are known in the art (see, e.g., Methods in Enzymology, Volume 194, Guide to Yeast Genetics and Molecular and Cell Biology (Part A, 2004, Christine Guthrie and Gerald R. Fink (Eds.), Elsevier Academic Press, San Diego, Calif.). Expression of genes in yeast typically requires a promoter, operably linked to a coding region of interest, and a transcriptional terminator. A number of yeast promoters can be used in constructing expression cassettes for genes in yeast, including, but not limited to, promoters derived from the following genes: CYC1, HIS3, GAL1, GAL10, ADH1, PGK, PHO5, GAPDH, ADC1, TRP1, URA3, LEU2, ENO, TPI, CUP1, FBA, GPD, GPM, and AOX1. Suitable transcriptional terminators include, but are not limited to, FBAt, GPDt, GPMt, ERG10t, GAL1t, CYC1, and ADH1.

Suitable promoters, transcriptional terminators, and DHAD coding regions may be cloned into *E. coli*-yeast shuttle vectors, and transformed into yeast cells. These vectors allow strain propagation in both *E. coli* and yeast strains. In one embodiment, the vector used contains a selectable marker and sequences allowing autonomous replication or chromosomal integration in the desired host. Examples of plasmids used in yeast are shuttle vectors pRS423, pRS424, pRS425, and pRS426 (American Type Culture Collection, Manassas, Va.), which contain an *E. coli* replication origin (e.g., pMB1), a yeast 2-micron origin of replication, and a marker for nutritional selection. The selection markers for these four vectors are His3 (vector pRS423), Trp1 (vector pRS424), Leu2 (vector pRS425) and Ura3 (vector pRS426). Construction of expression vectors with a chimeric gene encoding the described DHADs can be performed by either standard molecular cloning techniques in *E. coli* or by the gap repair recombination method in yeast.

The gap repair cloning approach takes advantage of the highly efficient homologous recombination in yeast. For example, a yeast vector DNA is digested (e.g., in its multiple cloning site) to create a "gap" in its sequence. A number of insert DNAs of interest are generated that contain a ≥21 bp sequence at both the 5' and the 3' ends that sequentially overlap with each other, and with the 5' and 3' terminus of the vector DNA. For example, to construct a yeast expression vector for "Gene X," a yeast promoter and a yeast terminator are selected for the expression cassette. The promoter and terminator are amplified from the yeast genomic DNA, and Gene X is either PCR amplified from its source organism or obtained from a cloning vector comprising Gene X sequence. There is at least a 21 bp overlapping sequence between the 5' end of the linearized vector and the promoter sequence, between the promoter and Gene X, between Gene X and the terminator sequence, and between the terminator and the 3' end of the linearized vector. The "gapped" vector and the insert DNAs are then co-transformed into a yeast strain and plated on the medium containing the appropriate compound mixtures that allow complementation of the nutritional selection markers on the plasmids. The presence of correct insert combinations can be confirmed by PCR mapping using plasmid DNA prepared from the selected cells. The plasmid DNA isolated from yeast (usually low in concentration) can then be transformed into an *E. coli* strain, e.g. TOP10, followed by mini preps and restriction mapping to further verify the plasmid construct. Finally, the construct can be verified by sequence analysis.

Like the gap repair technique, integration into the yeast genome also takes advantage of the homologous recombination system in yeast. For example, a cassette containing a coding region plus control elements (promoter and terminator) and auxotrophic marker is PCR-amplified with a high-fidelity DNA polymerase using primers that hybridize to the cassette and contain 40-70 base pairs of sequence homology to the regions 5' and 3' of the genomic area where insertion is desired. The PCR product is then transformed into yeast and plated on medium containing the appropriate compound mixtures that allow selection for the integrated auxotrophic marker. For example, to integrate "Gene X" into chromosomal location "Y", the promoter-coding regionX-terminator construct is PCR amplified from a plasmid DNA construct and joined to an autotrophic marker (such as URA3) by either SOE PCR or by common restriction digests and cloning. The full cassette, containing the promoter-coding regionX-terminator-URA3 region, is PCR amplified with primer sequences that contain 40-70 bp of homology to the regions 5' and 3' of location "Y" on the yeast chromosome. The PCR product is transformed into yeast and selected on growth media lacking uracil. Transformants can be verified either by colony PCR or by direct sequencing of chromosomal DNA.

In addition to the above materials and methods that may be used to express a heterologous DHAD, these same, or similar, materials and methods may be used to over-express a heterologous DHAD using modifications known to one of skill in the art. For example, when using a plasmid-based system to over-express the recombinant polynucleotide, a high-copy number vector, or a vector with a copy number that can be regulated, may be constructed. Such a regulatable or inducible system is described herein in Example 1; however, other systems are known to one of skill in the art and may be used to construct other high-copy number or copy number regulatable vectors. Alternatively, when using an integration-based system to over-express the recombinant polypeptide, an integration vector is required for targeting at multiple integration sites. A multiple integration-based system is described herein in Example 2; however, other multiple integration-based systems are known to one of skill in the art and may be used to target multiple integrations of a recombinant polypeptide, for example integration into rDNA regions.

Expression of the heterologous DHAD in the recombinant host cell can be quantified, e.g., by a percent of total cell protein. Such over-expression can be quantified in an amount selected from the group consisting of: (a) greater than about 0.001% of total cell protein; (b) greater than about 0.01% of total cell protein; (c) greater than about 0.1% of total cell protein; (d) greater than about 0.5% of total cell protein; (e) greater than about 1.0% of total cell protein; (f) greater than about 2.0% of total cell protein; (g) greater than about 5% of total cell protein; (h) greater than about 10% of total cell protein; and (i) greater than about 20% of total cell protein.

The specific activity of the heterologous DHAD produced in a recombinant host cell can be quantified, e.g., as U/mg. The heterologous DHAD specific activity can be selected from the group consisting of: (a) greater than about 0.25

U/mg; (b) greater than about 0.3 U/mg; (c) greater than about 0.5 U/mg; (d) greater than about 1.0 U/mg; (e) greater than about 1.5 U/mg; (f) greater than about 2.0 U/mg; (g) greater than about 3.0 U/mg; (h) greater than about 4.0 U/mg; (i) greater than about 5.0 U/mg; (j) greater than about 6.0 U/mg; (k) greater than about 7.0 U/mg; (l) greater than about 8.0 U/mg; (m) greater than about 9.0 U/mg; (n) greater than about 10.0 U/mg; (o) greater than about 20.0 U/mg; and (p) greater than about 50.0 U/mg.

The heterologous DHAD specific activity can also be quantified, e.g., as a percent comparison to an endogenous DHAD specific activity or to some other control DHAD specific activity. An example of a "control" DHAD specific activity is that from a heterologous DHAD expressed in a recombinant host cell using a low copy number plasmid or a plasmid that is not otherwise inducible or regulatable. Such a control establishes a baseline from which to compare the specific activity of the same heterologous DHAD expressed in a recombinant host cell using a high copy number plasmid or a plasmid with copy number that can be regulated, or co-expressed with polynucleotides encoding polypeptides affecting Fe—S cluster biosynthesis or Fe uptake and utilization, as described below. Thus, the increase in specific activity of the heterologous DHAD when compared to the control DHAD specific activity can be in an amount selected from the group consisting of: greater than an about 10% increase; greater than an about 20% increase; greater than an about 30% increase; greater than an about 40% increase; greater than an about 50% increase; greater than an about 60% increase; greater than an about 70% increase; greater than an about 80% increase; greater than an about 90% increase; greater than an about 95% increase; greater than an about 98% increase; and greater than an about 99% increase. The heterologous DHAD specific activity can also be expressed by "fold increase" over control. Thus, the increase in specific activity can be selected from the group consisting of: (a) greater than about 2-fold higher, (b) greater than about 5-fold higher, (c) greater than about 8-fold higher, or (d) greater than about 10-fold higher than control.

Fe—S Cluster Forming Proteins and Fe Regulation, Utilization, and Homeostasis

As described above, DHAD enzymes require Fe—S clusters for functioning, therefore, they must be expressed in a host having the genetic machinery to produce and load Fe—S clusters into the apo-protein if they are going to be expressed in functional form. As described elsewhere herein, in normal yeast, the mitochondria play an important role in Fe—S cluster biosynthesis. The flux in the formation and movement of Fe—S cluster precursors from mitochondria to Fe—S cluster requiring proteins in the cytosol of normal yeast is believed to be limited. For example, after a point a further increase in the expression of the protein of heterologous DHADs in the cytosol does not result in a corresponding increase in DHAD activity. While not wishing to be bound by theory, it is believed that this is because the increased amounts of the heterologous DHAD are not getting loaded with the Fe—S cluster requisite for activity because the cell is not able to supply the increased demand for Fe—S clusters that arises in the conditions described above. Demonstrated herein is that yeast cells can be genetically modified in 2 ways (separately or contemporaneously) that will result in an increased fraction of the heterologous DHAD expressed in the cytosol being loaded with its requisite Fe—S cluster. One way is to modify the expression of yeast genes involved in the Fe—S cluster formation, such as Fe—S cluster biosynthesis pathway genes or Fe uptake and utilization genes. The other way is to express heterologous genes involved in Fe—S cluster biosynthesis or Fe uptake and utilization in the cytoplasm of yeast.

Yeast genes that encode polypeptides that are involved in Fe uptake and utilization and Fe—S cluster biosynthesis are candidates for modification of expression. In embodiments, the modification results in increased function of a selected Fe—S cluster requiring protein.

As an example, Aft1 has been found to act as a transcriptional activator for genes into the iron regulon (Kumanovics, et al. *J. Biol. Chem.*, 2008. 283, p. 10276-10286; Li, H., et al., *The Yeast Iron Regulatory Proteins Grx3/4 and Fra2 form Heterodimeric Complexes Containing a [2Fe-2S] Cluster with Cysteinyl and Histidyl Ligation.* Biochemistry, 2009. 48(40): p. 9569-9581. As exemplified herein, the deletion of known inhibitors of Aft1 translocation, results in an increase in specific activity of an Fe—S cluster requiring protein because it leads to an increase Fe—S cluster loading of the protein. While not wishing to be bound by theory, it is thus believed that altering expression of certain genes of the Fe regulon, whether directly or through deletion or upregulation of inhibitors, will likewise increase the loading and function of Fe—S cluster requiring proteins. For example, genes that play a role in, or are part of, Fe utilization and homeostasis in yeast, such as Fe Regulon genes, may be targeted for altered expression. Such genes are known in the art, and examples of these genes are listed in Table 7. (The list in Table 7 is taken from Rutherford, J. C., et al., *Activation of the Iron Regulon by the Yeast Aft1/Aft2 Transcription Factors Depends on Mitochondrial but Not Cytosolic Iron-Sulfur Protein Biogenesis., J. Biol. Chem.,* 2005. 280(11): p. 10135-10140; Foury, F. and D. Talibi, *Mitochondrial control of iron homeostasis. A genome wide analysis of gene expression in a yeast frataxin-deficient strain. J. Biol. Chem.,* 2001. 276(11): p. 7762-7768; and Shakoury-Elizeh, M., et al., *Transcriptional remodeling in response to iron deprivation in Saccharomyces cerevisiae. Mol. Biol. Cell,* 2004. 15(3): p. 1233-1243.)

TABLE 7

Examples of yeast genes associated with Fe uptake and utilization.

| Gene Name | Putative Function | Nucleic Acid SEQ ID NO: | Amino Acid SEQ ID NO: |
|---|---|---|---|
| ARN1 | Transporter, member of the ARN family of transporters that specifically recognize siderophore-iron chelates; responsible for uptake of iron bound to ferrirubin, ferrirhodin, and related siderophores | 805 | 738 |
| ARN2 | Transporter, member of the ARN family of transporters that specifically recognize siderophore-iron chelates; responsible for uptake of iron bound to the siderophore triacetylfusarinine C | 806 | 739 |
| ATX1 | Cytosolic copper metallochaperone that transports copper to the secretory vesicle copper transporter Ccc2p for eventual insertion into Fet3p, which is a multicopper oxidase required for high-affinity iron uptake | 802 | 735 |

TABLE 7-continued

Examples of yeast genes associated with Fe uptake and utilization.

| Gene Name | Putative Function | Nucleic Acid SEQ ID NO: | Amino Acid SEQ ID NO: |
|---|---|---|---|
| CCC2 | Cu(+2)-transporting P-type ATPase, required for export of copper from the cytosol into an extracytosolic compartment; has similarity to human proteins involved in Menkes and Wilsons diseases | 803 | 736 |
| COT1 | Vacuolar transporter that mediates zinc transport into the vacuole; overexpression confers resistance to cobalt and rhodium | 816 | 749 |
| ENB1 (ARN4) | Endosomal ferric enterobactin transporter, expressed under conditions of iron deprivation; member of the major facilitator superfamily; expression is regulated by Rcs1p and affected by chloroquine treatment | 808 | 741 |
| FET3 | Ferro-O2-oxidoreductase required for high-affinity iron uptake and involved in mediating resistance to copper ion toxicity, belongs to class of integral membrane multicopper oxidases | 800 | 733 |
| FET5 | Multicopper oxidase, integral membrane protein with similarity to Fet3p; may have a role in iron transport | 814 | 747 |
| FIT1 | Mannoprotein that is incorporated into the cell wall via a glycosylphosphatidylinositol (GPI) anchor, involved in the retention of siderophore-iron in the cell wall | 792 | 725 |
| FIT2 | Mannoprotein that is incorporated into the cell wall via a glycosylphosphatidylinositol (GPI) anchor, involved in the retention of siderophore-iron in the cell wall | 793 | 726 |
| FIT3 | Mannoprotein that is incorporated into the cell wall via a glycosylphosphatidylinositol (GPI) anchor, involved in the retention of siderophore-iron in the cell wall | 794 | 727 |
| FRE1 | Ferric reductase and cupric reductase, reduces siderophore-bound iron and oxidized copper prior to uptake by transporters; expression induced by low copper and iron levels | 795 | 728 |
| FRE2 | Ferric reductase and cupric reductase, reduces siderophore-bound iron and oxidized copper prior to uptake by transporters; expression induced by low copper and iron levels | 796 | 729 |
| FRE3 | Ferric reductase, reduces siderophore-bound iron prior to uptake by transporters; expression induced by low iron levels | 797 | 730 |
| FRE4 | Ferric reductase, reduces a specific subset of siderophore-bound iron prior to uptake by transporters; expression induced by low iron levels | 798 | 731 |
| FRE5 | Putative ferric reductase with similarity to Fre2p; expression induced by low iron levels; the authentic, non-tagged protein is detected in highly purified mitochondria in high-throughput studies | 799 | 732 |
| FRE6 | Putative ferric reductase with similarity to Fre2p; expression induced by low iron levels | 817 | 750 |
| FTH1 | Putative high affinity iron transporter involved in transport of intravacuolar stores of iron; forms complex with Fet5p; expression is regulated by iron; proposed to play indirect role in endocytosis | 813 | 746 |
| FTR1 | High affinity iron permease involved in the transport of iron across the plasma membrane; forms complex with Fet3p; expression is regulated by iron | 801 | 734 |
| HMX1 | ER localized, heme-binding peroxidase involved in the degradation of heme; does not exhibit heme oxygenase activity despite similarity to heme oxygenases; expression regulated by AFT1 | 823 | 756 |
| SIT1 (ARN3) | Ferrioxamine B transporter, member of the ARN family of transporters that specifically recognize siderophore-iron chelates; transcription is induced during iron deprivation and diauxic shift; potentially phosphorylated by Cdc28p | 807 | 740 |
| SMF3 | Putative divalent metal ion transporter involved in iron homeostasis; transcriptionally regulated by metal ions; member of the Nramp family of metal transport proteins | 815 | 741 |
| TIS11 (CTH2) | mRNA-binding protein expressed during iron starvation; binds to a sequence element in the 3'-untranslated regions of specific mRNAs to mediate their degradation; involved in iron homeostasis | 824 | 757 |
| VHT1 | High-affinity plasma membrane H+-biotin (vitamin H) symporter; mutation results in fatty acid auxotrophy; 12 transmembrane domain containing major facilitator subfamily member; mRNA levels negatively regulated by iron deprivation and biotin | 822 | 755 |

Based on their functions and association with Fe uptake and utilization, the proteins encoded by the genes disclosed in Table 7 are candidates for affecting Fe—S cluster biosynthesis. Additional yeast genes associated with Fe uptake and utilization or Fe—S cluster biosynthesis include those listed in Table 8.

TABLE 8

Genes Associated With Yeast Fe Uptake and Utilization or Fe—S Cluster Biosynthesis

| Gene Name | Nucleic Acid SEQ ID NO: | Amino Acid SEQ ID NO: | Putative Function |
| --- | --- | --- | --- |
| AFT1 | 770 | 703 | Transcription factor involved in iron utilization and homeostasis; binds the consensus site PyPuCACCCPu and activates the expression of target genes in response to changes in iron availability |
| AFT2 | 771 | 704 | Iron-regulated transcriptional activator; activates genes involved in intracellular iron use and required for iron homeostasis and resistance to oxidative stress; similar to Aft1p |
| AIM1 | 779 | 712 | Interacts with Grx3/4 |
| ARH1 | 855 | 837 | Oxidoreductase of the mitochondrial inner membrane, involved in cytoplasmic and mitochondrial iron homeostasis and required for activity of Fe—S cluster-containing enzymes; one of the few mitochondrial proteins essential for viability (see, e.g., Lill, R. and U. Muehlenhoff, Ann. Rev. Biochem. 77: 669-700 (2008)) |
| ATM1 | 830 | 763 | Mitochondrial inner membrane ATP-binding cassette (ABC) transporter, exports mitochondrially synthesized precursors of iron-sulfur (Fe/S) clusters to the cytosol (see, e.g., Lill, R. and U. Muehlenhoff, Ann. Rev. Biochem. 77: 669-700 (2008)) |
| BUD32 | 778 | 711 | Interacts with Grx3/4 and Aft1p |
| CAD1 (YAP2) | 791 | 724 | Stress responses including Fe deprivation; also regulates CTI6 and MRS4 genes |
| CCC1 | 811 | 744 | Putative vacuolar Fe2+/Mn2+ transporter; suppresses respiratory deficit of yfh1 mutants, which lack the ortholog of mammalian frataxin, by preventing mitochondrial iron accumulation |
| CFD1 | 834 | 767 | Highly conserved, iron-sulfur cluster binding protein localized in the cytoplasm; forms a complex with Nbp35p that is involved in iron-sulfur protein assembly in the cytosol (see, e.g., Lill, R. and U. Muehlenhoff, Ann. Rev. Biochem. 77: 669-700 (2008)) |
| CIA1 | 836 | 769 | WD40 repeat protein involved in assembly of cytosolic and nuclear iron-sulfur proteins; similar to the human Ciao1 protein; YDR267C is an essential gene (see, e.g., Lill, R. and U. Muehlenhoff, Ann. Rev. Biochem. 77: 669-700 (2008)) |
| CMK1 | 784 | 717 | Interacts with Grx4p |
| CTH1 | 825 | 758 | mRNA binding and degradation under Fe depletion conditions |
| CTI6 | 786 | 719 | Growth in low iron conditions |
| CYC8 (SSN6) | 787 | 720 | General transcriptional co-repressor, acts together with Tup1p; also acts as part of a transcriptional co-activator complex that recruits the SWI/SNF and SAGA complexes to promoters; can form the prion [OCT+] |
| DAP1 | 820 | 753 | |
| DRE2 | 781 | 714 | Interacts with Grx3p |
| ERV1 | 856 | 838 | Flavin-linked sulfhydryl oxidase of the mitochondrial intermembrane space (IMS), oxidizes Mia40p as part of a disulfide relay system that promotes IMS retention of imported proteins; ortholog of human hepatopoietin (ALR) (see, e.g., Lill, R. and U. Muehlenhoff, Ann. Rev. Biochem. 77: 669-700 (2008)) Central players of the export pathway are the ABC transporter Atm1p of the mitochondrial inner membrane, the sulfhydryl oxidase Erv1p of the intermembrane space, and the tripeptide glutathione (23, 27, 50) (see Gerber, J., et al., *Mol. Cell. Biol.* 24(11): 4848-57 (2004)) |
| ESA1 | 782 | 715 | Interacts with Grx4p/Aft1p |
| FET4 | 809 | 742 | Low-affinity Fe(II) transporter of the plasma membrane |
| FRA1 | 772 | 705 | Protein involved in negative regulation of transcription of iron regulon; forms an iron independent complex with Fra2p, Grx3p, and Grx4p; cytosolic; mutant fails to repress transcription of iron regulon and is defective in spore formation |
| FRA2 | 773 | 706 | Protein involved in negative regulation of transcription of iron regulon; forms an iron independent complex with Fra2p, Grx3p, and Grx4p; null mutant fails to repress iron regulon and is sensitive to nickel |
| GEF1 | 804 | 737 | Copper transporter/loading for Fet3p |
| GGC1 (YHM1) | 857 | 839 | Mitochondrial GTP/GDP transporter, essential for mitochondrial genome maintenance; has a role in mitochondrial iron transport; member of the mitochondrial carrier family |
| GRX1 | 858 | 840 | Hydroperoxide and superoxide-radical responsive heat-stable glutathione-dependent disulfide oxidoreductase with active site cysteine pair; protects cells from oxidative damage |
| GRX2 | 832 | 765 | Cytoplasmic glutaredoxin, thioltransferase, glutathione-dependent disulfide oxidoreductase involved in maintaining redox state of target proteins, also exhibits glutathione peroxidase activity, expression induced in response to stress |

TABLE 8-continued

Genes Associated With Yeast Fe Uptake and Utilization or Fe—S Cluster Biosynthesis

| Gene Name | Nucleic Acid SEQ ID NO: | Amino Acid SEQ ID NO: | Putative Function |
|---|---|---|---|
| GRX3 | 774 | 707 | Hydroperoxide and superoxide-radical responsive glutathione-dependent oxidoreductase; monothiol glutaredoxin subfamily member along with Grx4p and Grx5p; protects cells from oxidative damage |
| GRX4 | 775 | 708 | Hydroperoxide and superoxide-radical responsive glutathione-dependent oxidoreductase; monothiol glutaredoxin subfamily member along with Grx3p and Grx5p; protects cells from oxidative damage. |
| GRX5 | 831 | 764 | Hydroperoxide and superoxide-radical responsive glutathione-dependent oxidoreductase; mitochondrial matrix protein involved in the synthesis/assembly of iron-sulfur centers; monothiol glutaredoxin subfamily member along with Grx3p and Grx4p (see, e.g., Lill, R. and U. Muehlenhoff, Ann. Rev. Biochem. 77: 669-700 (2008)) |
| HDA1 | 790 | 723 | Interacts with Tup1p, Ssn6p for Aft1/2p regulation in the absence of heme |
| IBA57 | 859 | 841 | Mitochondrial matrix protein involved in the incorporation of iron-sulfur clusters into mitochondrial aconitase-type proteins; activates the radical-SAM family members Bio2p and Lip5p; interacts with Ccr4p in the two-hybrid system (see, e.g., Lill, R. and U. Muehlenhoff, Ann. Rev. Biochem. 77: 669-700 (2008)) |
| ISA1 | 860 | 842 | Mitochondrial matrix protein involved in biogenesis of the iron-sulfur (Fe/S) cluster of Fe/S proteins, isa1 deletion causes loss of mitochondrial DNA and respiratory deficiency; depletion reduces growth on nonfermentable carbon sources (see, e.g., Lill, R. and U. Muehlenhoff, Ann. Rev. Biochem. 77: 669-700 (2008)) |
| ISA2 | 861 | 843 | Protein required for maturation of mitochondrial and cytosolic Fe/S proteins, localizes to the mitochondrial intermembrane space, overexpression of ISA2 suppresses grx5 mutations (see, e.g., Lill, R. and U. Muehlenhoff, Ann. Rev. Biochem. 77: 669-700 (2008)) |
| ISU1 | 828 | 761 | Conserved protein of the mitochondrial matrix, performs a scaffolding function during assembly of iron-sulfur clusters, interacts physically and functionally with yeast frataxin (Yfh1p); isu1 isu2 double mutant is inviable (see, e.g., Lill, R. and U. Muehlenhoff, Ann. Rev. Biochem. 77: 669-700 (2008)) |
| ISU2 | 829 | 762 | Conserved protein of the mitochondrial matrix, required for synthesis of mitochondrial and cytosolic iron-sulfur proteins, performs a scaffolding function in mitochondria during Fe/S cluster assembly; isu1 isu2 double mutant is inviable (see, e.g., Lill, R. and U. Muehlenhoff, Ann. Rev. Biochem. 77: 669-700 (2008)) |
| JAC1 | 862 | 844 | Specialized J-protein that functions with Hsp70 in Fe—S cluster biogenesis in mitochondria, involved in iron utilization; contains a J domain typical to J-type chaperones; localizes to the mitochondrial matrix (see, e.g., Lill, R. and U. Muehlenhoff, Ann. Rev. Biochem. 77: 669-700 (2008)) |
| MGE1 | 863 | 845 | Mitochondrial matrix cochaperone, acts as a nucleotide release factor for Ssc1p in protein translocation and folding; also acts as cochaperone for Ssq1p in folding of Fe—S cluster proteins; homolog of E. coli GrpE (see, e.g., Lill, R. and U. Muehlenhoff, Ann. Rev. Biochem. 77: 669-700 (2008)) |
| MRS3 | 819 | 752 | Iron transporter that mediates Fe2+ transport across the inner mitochondrial membrane; mitochondrial carrier family member, similar to and functionally redundant with Mrs4p; active under low-iron conditions; may transport other cations (see, e.g., Lill, R. and U. Muehlenhoff, Ann. Rev. Biochem. 77: 669-700 (2008)) |
| MRS4 | 818 | 751 | Iron transporter that mediates Fe2+ transport across the inner mitochondrial membrane; mitochondrial carrier family member, similar to and functionally redundant with Mrs3p; active under low-iron conditions; may transport other cations (see, e.g., Lill, R. and U. Muehlenhoff, Ann. Rev. Biochem. 77: 669-700 (2008)) |
| MSN5 | 776 | 709 | Exporting Aft1p and other proteins from the nucleus |
| NAR1 | 833 | 766 | Component of the cytosolic iron-sulfur (FeS) protein assembly machinery, required for maturation of cytosolic and nuclear FeS proteins and for normal resistance to oxidative stress; homologous to human Narf (see, e.g., Lill, R. and U. Muehlenhoff, Ann. Rev. Biochem. 77: 669-700 (2008)) |
| NBP35 | 835 | 768 | Essential iron-sulfur cluster binding protein localized in the cytoplasm; forms a complex with Cfd1p that is involved in iron-sulfur protein assembly in the cytosol; similar to P-loop NTPases (see, e.g., Lill, R. and U. Muehlenhoff, Ann. Rev. Biochem. 77: 669-700 (2008)) |
| NFS1 | 864 | 846 | Cysteine desulfurase involved in iron-sulfur cluster (Fe/S) biogenesis; required for the post-transcriptional thio-modification of mitochondrial and cytoplasmic tRNAs; essential protein located predominantly in mitochondria (see, e.g., Lill, R. and U. Muehlenhoff, Ann. Rev. Biochem. 77: 669-700 (2008)) |
| NFU1 | 865 | 847 | Protein involved in iron utilization in mitochondria; similar to NifU, which is a protein required for the maturation of the Fe/S clusters of nitrogenase in nitrogen-fixing bacteria (see, e.g., Lill, R. and U. Muehlenhoff, Ann. Rev. Biochem. 77: 669-700 (2008)) |

TABLE 8-continued

Genes Associated With Yeast Fe Uptake and Utilization or Fe—S Cluster Biosynthesis

| Gene Name | Nucleic Acid SEQ ID NO: | Amino Acid SEQ ID NO: | Putative Function |
|---|---|---|---|
| NHP6a and b | 788,789 | 721,722 | Both are high-mobility group non-histone chromatin protein, functionally redundant with Nhp6Bp; homologous to mammalian high mobility group proteins 1 and 2; acts to recruit transcription factor Rcs1p to certain promoters |
| PSE1 | 777 | 710 | Importing Aft1p and other proteins to the nucleus |
| SMF1 | 810 | 743 | Low affinity Fe(II) transporter of the plasma membrane |
| SNF1 | 866 | 848 | AMP-activated serine/threonine protein kinase found in a complex containing Snf4p and members of the Sip1p/Sip2p/Gal83p family; required for transcription of glucose-repressed genes, thermotolerance, sporulation, and peroxisome biogenesis |
| SNF2 | 867 | 849 | Catalytic subunit of the SWI/SNF chromatin remodeling complex involved in transcriptional regulation; contains DNA-stimulated ATPase activity; functions interdependently in transcriptional activation with Snf5p and Snf6p |
| SNF3 | 868 | 850 | Plasma membrane glucose sensor that regulates glucose transport; has 12 predicted transmembrane segments; long cytoplasmic C-terminal tail is required for low glucose induction of hexose transporter genes HXT2 and HXT4 |
| SNF4 | 869 | 851 | Activating gamma subunit of the AMP-activated Snf1p kinase complex (contains Snf1p and a Sip1p/Sip2p/Gal83p family member); activates glucose-repressed genes, represses glucose-induced genes; role in sporulation, and peroxisome biogenesis |
| SSQ1 | 827 | 760 | Mitochondrial hsp70-type molecular chaperone, required for assembly of iron/sulfur clusters into proteins at a step after cluster synthesis, and for maturation of Yfh1p, which is a homolog of human frataxin implicated in Friedreich's ataxia (see, e.g., Lill, R. and U. Muehlenhoff, Ann. Rev. Biochem. 77: 669-700 (2008)) |
| TIM12 (MRS5) | 871 | 853 | Essential protein of the inner mitochondrial membrane, peripherally localized; component of the TIM22 complex, which is a twin-pore translocase that mediates insertion of numerous multispanning inner membrane protein. |
| TUP1 | 785 | 718 | General repressor of transcription |
| NP_011911.1 | 821 | 754 | |
| VPS41 (FET2) | 872 | 854 | Vacuolar membrane protein that is a subunit of the homotypic vacuole fusion and vacuole protein sorting (HOPS) complex; essential for membrane docking and fusion at the Golgi-to-endosome and endosome-to-vacuole stages of protein transport |
| YAH1 | 870 | 852 | Ferredoxin of the mitochondrial matrix required for formation of cellular iron-sulfur proteins; involved in heme A biosynthesis; homologous to human adrenodoxin (see, e.g., Lill, R. and U. Muehlenhoff, Ann. Rev. Biochem. 77: 669-700 (2008)) |
| YAP5 | 812 | 745 | Regulation (CCC1) |
| YFH1 (Frataxin) | 826 | 759 | Mitochondrial matrix iron chaperone; oxidizes and stores iron; interacts with Isu1p to promote Fe—S cluster assembly; mutation results in multiple Fe/S-dependent enzyme deficiencies; human frataxin homolog is mutated in Friedrich's ataxia (see, e.g., Lill, R. and U. Muehlenhoff, Ann. Rev. Biochem. 77: 669-700 (2008)) |
| YRA1 | 783 | 716 | Interacts with Grx4p |
| ZPR1 | 780 | 713 | Interacts with Aft1p |

Additional genes encoding polypeptides affecting Fe—S cluster biosynthesis from other host cells have been identified and include, but are not limited to, those genes listed in Table 9.

TABLE 9

Genes Directly Involved in Fe—S Cluster Biosynthesis from Various Cells

Gene Name
SEQ ID
NOs(Amino
Acid, Nucleic    Function
Acid)            (Accession; CDS)

Figure 6A:
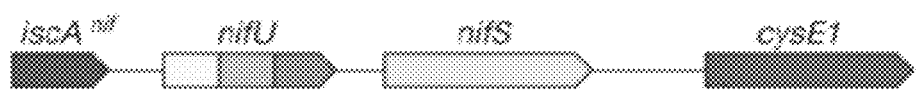
FIG. 6A depicts a schematic of Azotobacter vinelandii nif genes.
Figure 6B:
FIG. 6B depicts a schematic of additional Azotobacter vinelandii nif genes.

*Azotobacter vinelandii* nif genes
(FIGS. 6A and 6B; see Johnson, D. C., et al., *Ann. Rev. Biochem.* 74: 247-81 (2005))

| iscA$^{nif}$ (873, 894) | [Fe—S] cluster scaffold protein (see Johnson, D. C., et al., *Ann. Rev. Biochem.* 74: 247-81 (2005)) (YP_002797399.1; nucleotides 153037 to 153360 of NC_012560.1) |
|---|---|

TABLE 9-continued

Genes Directly Involved in Fe—S Cluster Biosynthesis from Various Cells

Gene Name
SEQ ID
NOs(Amino
Acid, Nucleic
Acid) — Function (Accession; CDS)

nifU (875, 896)
NifU is a scaffold protein for assembly and transfer of iron-sulfur clusters (see Johnson, D. C., et al., *Ann. Rev. Biochem.* 74: 247-81 (2005)).
(YP_002797400.1; nucleotides 153425 to 154363 of NC_012560.1)

nifS (874, 895)
Cysteine desulfurase involved in the mobilization of S for nitrogenase maturation (see Johnson, D. C., et al., *Ann. Rev. Biochem.* 74: 247-81 (2005)).
(YP_002797401.1; nucleotides 154365 to 155573 of NC_012560.1)

cysE1 (876, 897)
Involved in cysteine biosynthesis (see Johnson, D. C., et al., *Ann. Rev. Biochem.* 74: 247-81 (2005))
(YP_002797403.1; nucleotides 156797 to 157594 of NC_012560.1)

cysE2 (929, 947)
Involved in cysteine biosynthesis (see Johnson, D. C., et al., *Ann. Rev. Biochem.* 74: 247-81 (2005))
(YP_002801153.1; reverse complement of nucleotides 4092159 to 4092938 of NC_012560.1)

iscS (930, 948)
Cysteine desulfurase involved in the mobilization of S (see Johnson, D. C., et al., *Ann. Rev. Biochem.* 74: 247-81 (2005))
(YP_002801151.1; reverse complement of nucleotides 4090290 to 4091504 of NC_012560.1)

iscU (931, 949)
[Fe—S] cluster scaffold protein (see Johnson, D. C., et al., *Ann. Rev. Biochem.* 74: 247-81 (2005))
(YP_002801150.1; reverse complement of nucleotides 4089860 to 4090246 of NC_012560.1)

iscA (932, 950)
[Fe—S] cluster scaffold protein (see Johnson, D. C., et al., *Ann. Rev. Biochem.* 74: 247-81 (2005))
(YP_002801149.1; reverse complement of nucleotides 4089511 to 4089834 of NC_012560.1)

hscB (933, 951)
HscB heat shock cognate protein associated with Isc-directed [Fe—S] protein maturation (see Johnson, D. C., et al., *Ann. Rev. Biochem.* 74: 247-81 (2005))
(YP_002801148.1; reverse complement of nucleotides 4088980 to 4089501 of NC_012560.1)

hscA (934, 952)
HscA heat shock cognate protein associated with Isc-directed [Fe—S] protein maturation (see Johnson, D. C., et al., *Ann. Rev. Biochem.* 74: 247-81 (2005))
(YP_002801147.1; reverse complement of nucleotides 4087072 to 4088937 of NC_012560.1)

Fdx (935, 953)
Ferredoxin
(YP_002801146.1; reverse complement of nucleotides 4086730 to 4087071 of NC_012560.1)

sufS (936, 954)
Cysteine desulfurase involved in the mobilization of S (see Johnson, D. C., et al., *Ann. Rev. Biochem.* 74: 247-81 (2005))
(YP_002801025.1; nucleotides 3961166 to 3962515 of NC_012560.1)

sufE (937, 955)
(YP_002801026.1; nucleotides 3962512 to 3962916 of NC_012560.1)

cysE3 (938, 956)
Involved in cysteine biosynthesis (see Johnson, D. C., et al., *Ann. Rev. Biochem.* 74: 247-81 (2005))
(YP_002799274.1; nucleotides 2093069 to 2094052 of NC_012560.1)

sufS2 (939, 957)
Cysteine desulfurase involved in the mobilization of S (see Johnson, D. C., et al., *Ann. Rev. Biochem.* 74: 247-81 (2005))
(YP_002799276.1; nucleotides 2095267 to 2097081 of NC_012560.1)

iscA2 also known as eprA (877, 898)
[Fe—S] cluster scaffold protein (see Johnson, D. C., et al., *Ann. Rev. Biochem.* 74: 247-81 (2005))
(YP_002801687.1; reverse complement of nucleotides 4681573 to 4681923 of NC_012560.1)

Figure 6C:
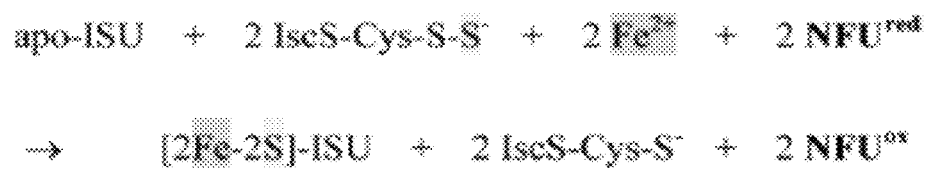
FIG. 6C depicts a schematic of the equation in which NFU acts as a persulfide reductase.

Nfu also known as NfuA (878, 899)
Human nfu appears to be a persulfide reductase according to the equation shown in FIG. 6C. (see Liu, Y., W. Qi, and J. A. Cowan, *Biochem.* 48(5): 973-80 (2009))
(YP_002800022.1; reverse complement of nucleotides 2961161 to 2961745 of NC_012560.1)

nfuA also known as AnfU (879, 900)
Spectroscopic and analytical studies indicate that one [4Fe—4S] cluster can be assembled in vitro within a dimeric form of NfuA. The resultant [4Fe—4S] cluster-loaded form of NfuA is competent for rapid in vitro activation of apo-aconitase. Based on these results a model is proposed where NfuA could represent a class of intermediate [Fe—S] cluster carriers involved in [Fe—S] protein maturation. (see Bandyopadhyay, S., et al., *J Biol. Chem.* 283(20): 14092-99 (2008))
(YP_002801977.1; nucleotides 4963727 to 4964017 of NC_012560.1)

nfuV also known as VnfU
Could have specialized functions related to the maturation, protection, or repair of specific [Fe—S] proteins (see Johnson, D. C., et al., *Ann. Rev. Biochem.* 74: 247-81 (2005)).

TABLE 9-continued

Genes Directly Involved in Fe—S Cluster Biosynthesis from Various Cells

Gene Name
SEQ ID
NOs(Amino
Acid, Nucleic
Acid)　　　Function
　　　　　　(Accession; CDS)

| Gene (SEQ IDs) | Function (Accession; CDS) |
|---|---|
| (880, 901) | (YP_002797514.1; reverse complement of nucleotides 263828 to 264118 of NC_012560.1) |

Figure 7:
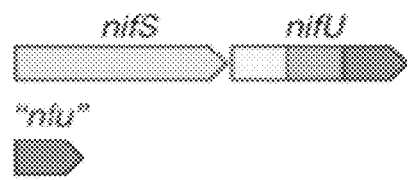
FIG. 7 depicts a schematic of Helicobacter pylori nif genes.

*Helicobacter pylori* nif genes
(FIG. 7; see Johnson, D. C., et al., *Ann. Rev. Biochem.* 74: 247-81 (2005))

| Gene (SEQ IDs) | Function (Accession; CDS) |
|---|---|
| nifS (881, 902) | NifS is a cysteine desulfurase. (YP_003057033.1; nucleotides 218891 to 220054 of NC_012973.1) |
| nifU (882, 903) | NifU is a scaffold protein for assembly and transfer of iron-sulfur clusters. (YP_003057034.1; nucleotides 220076 to 221056 of NC_012973.1) |
| nfu (927, 945) | (YP_003058109.1; nucleotides 1448886 to 1449155 of NC_012973.1) |
| iscS (928, 946) | (YP_003057709.1; reverse complement of nucleotides 1012615 to 1013937 of NC_012973.1) |

Figure 8:
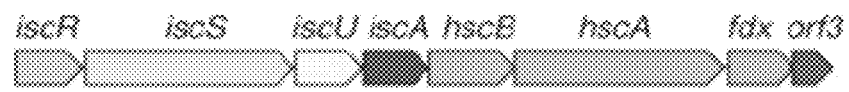
FIG. 8 depicts a schematic of E. coli isc genes.

*E. coli* isc genes
(FIG. 8; see Johnson, D. C., et al., *Ann. Rev. Biochem.* 74: 247-81 (2005))

| Gene (SEQ IDs) | Function (Accession; CDS) |
|---|---|
| iscS (883, 904) | EcoCyc: IscS is a cysteine desulfurase that catalyzes the conversion of cysteine into alanine and sulfur via intermediate formation of a cysteine persulfide. (YP_026169.1; reverse complement of nucleotides 2658339 to 2659553 of NC_000913.2) |
| iscU (884, 905) | EcoCyc: IscU is a scaffold protein for assembly and transfer of iron-sulfur clusters. IscU is able to form 2Fe—2S clusters and transfer them to apo-ferredoxin, acting catalytically. The chaperones HscA and HscB and ATP hydrolysis by HscA accelerate cluster transfer. (NP_417024.1; reverse complement of nucleotides 2657925 to 2658311 of NC_000913.2) |
| iscA (885, 906) | EcoCyc: IscA is an iron-sulfur cluster assembly protein that forms the [2Fe—2S] cluster of ferredoxin. It has been shown to bind iron with an apparent association constant of $3 \times 10-19$ $M^{-1}$. In vitro in the presence of IscS and cysteine, IscA can provide iron to iscU. Native [2Fe—2S] SufA can transfer its Fe—S cluster to both [2Fe—2S] and [4Fe—4S] apoproteins. (see Gupta, V., et al., *J. Am. Chem. Soc.* 131(17): 6149-53 (2009)) The results suggest that the biogenesis of the [4Fe—4S] clusters and the [2Fe—2S] clusters may have distinct pathways and that IscA/SufA paralogues are essential for the [4Fe—4S] cluster assembly, but are dispensable for the [2Fe—2S] cluster assembly in *E. coli* under aerobic conditions. (Tan, G., et al., *Biochem. J.*, 420(3): 463-72 (2009)) (NP_417023.1; reverse complement of nucleotides 2657585 to 2657908 of NC_000913.2) |
| hscB (886, 907) | EcoCyc: HscB is a co-chaperone that stimulates HscA (Hsc66) ATPase activity. HscB does not exhibit its own chaperone activity. HscB is required for wild-type stimulation of HscA ATPase activity by the substrate, IscU, and for wild-type interaction between HscA and IscU. This system is involved in iron-sulfur cluster assembly. (NP_417022.1; reverse complement of nucleotides 2656974 to 2657489 of NC_000913.2) |
| hscA (887, 908) | EcoCyc: Hsc66 together with Hsc20 may comprise a chaperone system similar to DnaK/DnaJ. Hsc66 is required for the assembly of iron-sulfur clusters. IscU may be a substrate for Hsc66. In the presence of Hsc20, IscU stimulates the ATPase activity of Hsc66 up to 480-fold; the in vivo turnover rate of the chaperone cycle may be determined by the availability of the IscU-Hsc20 complex. Hsc66 directly interacts with IscU, IscA, and Fdx. (NP_417021.1; reverse complement of nucleotides 2655107 to 2656957 of NC_000913.2) |
| Fdx (888, 909) | EcoCyc: [2Fe—2S] ferridoxin (NP_417020.1; reverse complement of nucleotides 2654770 to 2655105 of NC_000913.2) |

Figure 9:
FIG. 9 depicts a schematic of E. coli suf genes.

*E. coli* suf genes
(FIG. 9; see Johnson, D. C., et al., *Ann. Rev. Biochem.* 74: 247-81 (2005))

| Gene (SEQ IDs) | Function (Accession; CDS) |
|---|---|
| sufA (889, 910) | EcoCyc: SufA is part of the protein machinery that is involved in the biosynthesis of iron-sulfur clusters. In vitro, purified apoSufA can chelate iron-sulfur clusters by treatment with iron and sulfide under anaerobic conditions. HoloSufA then can form a fast and tight association with the target apoprotein biotin synthase (BioB) and transfers a [4Fe—4S] cluster to BioB in a slow reaction. (NP_416199.1; reverse complement of nucleotides 1762042 to 1762410 of NC_000913.2) |

TABLE 9-continued

Genes Directly Involved in Fe—S Cluster Biosynthesis from Various Cells

| Gene Name SEQ ID NOs(Amino Acid, Nucleic Acid) | Function (Accession; CDS) |
|---|---|
| sufB (890, 911) | EcoCyc: The SufB-SufC-SufD complex activates the cysteine desulfurase activity SufS in conjunction with the SufE sulfur acceptor protein. (NP_416198.2; reverse complement of nucleotides 1760546 to 1762033 of NC_000913.2) |
| sufC (891, 912) | EcoCyc: SufC is part of the protein machinery that is involved in the biosynthesis of iron-sulfur clusters. The SufB-SufC-SufD complex activates the cysteine desulfurase activity of SufS in conjunction with the SufE sulfur acceptor protein. (NP_416197.1; reverse complement of nucleotides 1759790 to 1760536 of NC_000913.2) |
| sufD (892, 913) | EcoCyc: The SufB-SufC-SufD complex activates the cysteine desulfurase activity SufS in conjunction with the SufE sulfur acceptor protein (NP_416196.1; reverse complement of nucleotides 1758544 to 1759815 of NC_000913.2) |
| sufS (893, 914) | EcoCyc: SufS is a member of the NifS protein family. SufS exhibits activity with respect to assembly of the ferredoxin iron-sulfur cluster in an in vitro assay. (NP_416195.1; reverse complement of nucleotides 1757327 to 1758547 of NC_000913.2) |
| sufE1 also known as suf E (925, 943) | (NP_416194.1; reverse complement of nucleotides 1756898 to 1757314 of NC_000913.2) |
| sufS2 also known as csdA (924, 942) | (NP_417290.1; NC_000913.2 nucleotides 2941359 to 2942564) |
| sufE2 also known as csdE (926, 944) | (NP_417291.1; nucleotides 2942564 to 2943007 of NC_000913.2) |
| iscA2 also known as erpA (922, 940) | (NP_414698.1; nucleotides 176610 to 176954 of NC_000913.2) |
| nfu also known as nfuA (923, 941) | (NP_417873.1; nucleotides 3543646 to 3544221 of NC_000913.2) |

Fe uptake and metabolism and/or Fe—S cluster biosynthesis genes, including, but not limited to, those listed in Tables 7, 8 or 9 can potentially be deleted, mutated, expressed, up-regulated, or down-regulated to increase the flux in an Fe—S cluster biosynthesis pathway and improve specific activity of Fe—S cluster requiring proteins such as DHAD. In addition, co-factors can be added to change the activity of polypeptides having Fe—S cluster regulatory activity to increase the flux in an Fe—S cluster biosynthesis pathway and improve DHAD specific activity.

For example, the genes that increase the flux in an Fe—S cluster biosynthesis pathway can be expressed to improve the activity of DHAD by providing an adequate amount of Fe—S clusters for the apo-enzyme. Any gene, or a combination of them, such as one or more genes listed in Tables 7, 8, or 9, can be cloned and expressed in a pRS411 plasmid as described in Example 4. The resulting constructs, along with the DHAD expression vector pHR81 FBA ilvD(Sm), can then be transformed into wild-type BY4741. As a control, pRS411 without any gene of interest and vector pHR81 FBA ilvD(Sm) are transformed into a wild-type strain. The transformants are selected on agar plates with SD medium without uracil and methionine to maintain both plasmids as described in Example 4. Enzymatic activity for DHAD in the crude extract of different strains from the transformation can be measured. The results can be compared with the specific activity obtained from the control pRS411 without any gene of interest and vector pHR81 FBA ilvD(Sm) transformed into a wild-type strain. An increase in specific activity indicates a gene that can be used to increase the flux in an Fe—S cluster biosynthesis pathway.

In addition, strains with deletions in more than one of the genes involved in Fe—S cluster regulatory activity can be created to provide additive effects in improving the enzymes or proteins containing Fe—S cluster(s). For example, double mutants with deletions in both FRA2 and GXR3 genes can be used to transform vector pHR81 FBA-IlvD(sm), and the DHAD activity in the crude extract from the transformants can be measured.

Another alternative is to alter the expression of, e.g., the PSE1 (SEQ ID NO:777) gene, which encodes a protein involved in the import of Aft1p into the nucleus (Fukunaka, et al, 2003, J. Biological Chem., vol. 278, pp. 50120-50127). Expression of this gene can be accomplished by cloning it in vector pRS411 as described above.

Thus, provided herein are recombinant host cells that comprise an alteration in the expression of any polypeptide encoded by an Fe uptake and utilization or an Fe—S cluster biosynthesis gene. Encompassed are recombinant host cells that comprise at least one heterologous polynucleotide of any one of the above-referenced Fe—S cluster biosynthesis genes. Also encompassed are recombinant host cells, wherein the host cell comprises at least one deletion, mutation, and/or substitution in an endogenous gene of any one of the above-referenced Fe uptake and utilization or Fe—S cluster biosynthesis genes. Also provided are recombinant host cells that comprise at least one heterologous polynucleotide of any one of the above-referenced Fe uptake and utilization or Fe—S cluster biosynthesis genes, wherein the host cell comprises at least one deletion, mutation, and/or substitution in an endogenous gene of any one of the above-referenced Fe uptake and utilization or Fe—S cluster biosynthesis genes.

These recombinant host cells can also comprise at least one heterologous Fe—S cluster requiring protein. For example, provided herein is a recombinant host cell comprising at least one heterologous DHAD and at least one heterologous polynucleotide encoding a polypeptide affecting Fe—S cluster biosynthesis. Also provided is a recombinant host cell comprising at least one heterologous DHAD, wherein the host cell comprises at least one deletion, mutation, and/or substitution in an endogenous gene encoding a polypeptide affecting Fe—S cluster biosynthesis. Also provided is a recombinant host cell comprising at least one heterologous DHAD and at least one heterologous polynucleotide encoding a polypeptide affecting Fe—S cluster biosynthesis, wherein the host cell comprises at least one deletion, mutation, and/or substitution in an endogenous gene encoding a polypeptide affecting Fe—S cluster biosynthesis.

Host cells that can be used in the present invention include yeast host cells including, but not limited to, *Saccharomyces, Schizosaccharomyces, Hansenula, Candida, Kluyveromyces, Yarrowia, Issatchenkia*, and *Pichia*. Bacterial host cells can also be used to create recombinant host cells that comprise at least one heterologous polynucleotide encoding a polypeptide having DHAD activity and at least one heterologous polynucleotide encoding a polypeptide affecting Fe—S cluster biosynthesis. For example, lactic acid bacteria comprising recombinant DHAD and at least one recombinant genetic expression element encoding Fe—S cluster forming proteins are the subject of U.S. application Ser. No. 12/569,103, filed Sep. 29, 2009, which is incorporated by reference herein. The present recombinant host cells comprising at least one heterologous polynucleotide encoding a polypeptide having DHAD activity and at least one heterologous polynucleotide encoding a polypeptide affecting Fe—S cluster biosynthesis do not include those lactic acid bacteria described in U.S. application Ser. No. 12/569,103, filed Sep. 29, 2009, which is incorporated by reference herein.

The polypeptide affecting Fe—S cluster biosynthesis can be selected from the group consisting of the Fe uptake and utilization or Fe—S cluster biosynthesis pathway genes in Tables 7, 8 and 9. In one embodiment, the polypeptide affecting Fe—S cluster biosynthesis is encoded by ARN1, ARN2, ATX1, CCC2, COT1, ENB1, FET3, FET5, FIT1, FIT2, FIT3, FRE1, FRE2, FRE3, FRE4, FRE5, FRE6, FTH1, FTR1, HMX1, SIT1, SMF3, TIS11, VHT1, AFT1, AFT2, AIM1, ARH1, ATM1, BUD32, CAD1, CCC1, CFD1, CIA1, CMK1, CTH1, CTI6, CYC8, DAP1, DRE2, ERV1, ESA1, FET4, FRA1, FRA2, GEF1, GGC1, GRX1, GRX2, GRX4, GRX5, HDA1, IBA57, ISA1, ISA2, ISU1, ISU2, JAC1, MGE1, MRS3, MRS4, MSN5, NAR1, NFS1, NFU1, NHP6a, NHP6b, PSE1, SMF1, SNF1, SNF2, SNF3, SNF4, SSQ1, TIM12, TUP1, NP_011911.1, VPS41, YAP5, YFH1, YRA1, ZPR1, iscA$^{nif}$, nifU, nifS, cysE1, cysE2, iscS, iscU, iscA, hscB, hscA, Fdx, sufS, sufE, cysE3, sufS2, iscA2, Nfu, nfuA, nfuV, nfu, sufA, sufB, sufC, sufD, sufE1, sufS2, or sufE2. In one embodiment, the polypeptide affecting Fe—S cluster biosynthesis is AFT1, AFT2, PSE1, FRA2, GRX3, or MSN5. In one embodiment, the polypeptide affecting Fe—S cluster biosynthesis is selected from the group consisting of AFT1, AFT2, PSE1, FRA2, GRX3, MSN5, and combinations thereof. In one embodiment, the polypeptide affecting Fe—S cluster biosynthesis is selected from the group consisting of AFT1, AFT2, PSE1, FRA2, MSN5, and combinations thereof. In another embodiment, the polypeptide affecting Fe—S cluster biosynthesis is selected from the group consisting of AFT1, AFT2, PSE1, FRA2, GRX3, MSN5, and combinations thereof, and the polypeptide affecting Fe—S cluster biosynthesis is encoded by a polynucleotide comprising a plasmid. In some embodiments, DHAD is co-expressed with AFT1, AFT2, PSE1, and combinations thereof. The polypeptide affecting Fe—S cluster biosynthesis may be a constitutive mutant, such as, but not limited to, AFT1 L99A, AFT1 L102A, AFT1 C291F, AFT1 C293F, and combinations thereof. The deletion, mutation, and/or substitution in the endogenous gene encoding a polypeptide affecting Fe—S cluster biosynthesis can be selected from the group consisting of FRA2, GRX3, MSN5, and combinations thereof.

The present invention also provides a method for increasing the activity of an Fe—S cluster requiring protein in a recombinant host cell comprising providing a recombinant host cell comprising an Fe—S cluster requiring protein, changing the expression or activity of a polypeptide affecting Fe—S cluster biosynthesis in the host cell, and growing the recombinant host cell with the changed expression or activity under conditions whereby the activity of the Fe—S cluster requiring protein is increased. Such a method can be used to increase the activity of an endogenous Fe—S cluster requiring protein, or a heterologous Fe—S cluster requiring protein. Such a method can be used to increase the specific activity of a DHAD described herein, or identified by the methods described herein. The increase in the activity of the Fe—S cluster requiring protein can be in an amount selected from greater than about 10%; greater than about 15%; greater than about 20%; greater than about 25%; greater than about 30%; greater than about 35%; greater than about 40%; greater than about 45%; greater than about 50%; greater than about 55%; greater than about 60%; greater than about 65%; greater than about 70%; greater than about 75%; greater than about 80%; greater than about 85%; greater than about 90%; and greater than about 95%. The increase in activity may be greater than about 3 fold, greater than about 5 fold, greater than about 8 fold, or greater than about 10 fold. In embodiments, the activity of the Fe—S cluster requiring protein can be in an amount that is at least about 60% of theoretical, at least about 70% of theoretical, at least about 80% theoretical, or at least about 90% theoretical.

The present invention can also be used to increase the flux in the Fe—S cluster biosynthesis pathway in a host cell and to identify polypeptides that increase the flux in an Fe—S cluster biosynthesis pathway in a host cell. In one embodiment a method is provided for increasing the flux in an Fe—S cluster biosynthesis pathway in a host cell comprising providing a recombinant host cell comprising an Fe—S cluster requiring protein and either at least one polypeptide affecting Fe—S cluster biosynthesis, at least one deletion, mutation, and/or substitution in an endogenous gene encoding a polypeptide affecting Fe—S cluster biosynthesis, or a combination of both, and growing the recombinant host cell under conditions whereby the flux in the Fe—S cluster biosynthesis pathway in the host cell is increased. In another embodiment, a method is provided for identifying polypeptides that increase the flux in an Fe—S cluster biosynthesis pathway in a host cell comprising: (a) changing the expression or activity of a polypeptide affecting Fe—S cluster biosynthesis; (b) measuring the activity of a Fe—S cluster requiring protein; and (c) comparing the activity of the Fe—S cluster requiring protein measured in the presence of the change in expression or activity polypeptide of step (a) to the activity of the Fe—S cluster requiring protein measured in the absence of the change in expression or activity polypeptide of step (a), wherein an increase in the activity of the heterologous Fe—S cluster requiring protein indicates an increase in the flux in said Fe—S cluster biosynthesis pathway. In such methods, the Fe—S cluster requiring protein may be endogenous or heterologous to the host cell.

The expression or activity of the polypeptide affecting Fe—S cluster biosynthesis can be changed by methods well known in the art, including, but not limited to, deleting, mutating, substituting, expressing, up-regulating, down-regulating, altering the cellular location, altering the state of the protein, and/or adding a cofactor, and combinations thereof. Altering the state of the protein can include, but are not limited to, such alterations as phosphorylation or ubiquitination. Any number of methods described herein or known in the art can be used to measure the activity of the Fe—S cluster requiring protein, depending upon the Fe—S cluster requiring protein chosen. For example, if DHAD is the Fe—S cluster requiring protein, the assay described in the Example 7 can be used to measure the activity of the DHAD to determine if there is an increase in the flux in the Fe—S cluster biosynthesis pathway of the host cell.

Isobutanol and Other Products

Expression of a DHAD in a recombinant host cell, as described herein, provides the transformed, recombinant host cell with dihydroxy-acid dehydratase activity for conversion of 2,3-dihydroxyisovalerate to α-ketoisovalerate or 2,3-dihydroxymethylvalerate to α-ketomethylvalerate. A product that has α-ketoisovalerate or α-ketomethylvalerate as a pathway intermediate may be produced with greater effectiveness in a host cell disclosed herein having the described heterologous DHAD. A list of such products includes, but is not limited to, valine, isoleucine, leucine, pantothenic acid, 2-methyl-1-butanol, 3-methyl-1-butanol, and isobutanol.

For example, biosynthesis of valine in yeast includes steps of acetolactate conversion to 2,3-dihydroxy-isovalerate by acetohydroxyacid reductoisomerase (ILV5), conversion of 2,3-dihydroxy-isovalerate to α-ketoisovalerate (also called 2-keto-isovalerate) by dihydroxy-acid dehydratase, and conversion of α-ketoisovalerate to valine by branched-chain amino acid transaminase (BAT2) and branched-chain amino acid aminotransferase (BAT1). Biosynthesis of leucine includes the same steps to α-ketoisovalerate, followed by conversion of α-ketoisovalerate to alpha-isopropylmalate by alpha-isopropylmalate synthase (LEU9, LEU4), conversion of alpha-isopropylmalate to beta-isopropylmalate by isopropylmalate isomerase (LEU1), conversion of beta-isopropylmalate to alpha-ketoisocaproate by beta-IPM dehydrogenase (LEU2), and finally conversion of alpha-ketoisocaproate to leucine by branched-chain amino acid transaminase (BAT2) and branched-chain amino acid aminotransferase (BAT1). The bacterial pathway is similar, involving differently named proteins and genes. Increased conversion of 2,3-dihydroxy-isovalerate to α-ketoisovalerate will increase flow in these pathways, particularly if one or more additional enzymes of a pathway is overexpressed. Thus, it is desired for production of valine or leucine to use a strain disclosed herein.

Biosynthesis of pantothenic acid includes a step performed by DHAD, as well as steps performed by ketopantoate hydroxymethyltransferase and pantothenate synthase. Engineering of expression of these enzymes for enhanced production of pantothenic acid biosynthesis in microorganisms is described in U.S. Pat. No. 6,177,264.

Figure 5:
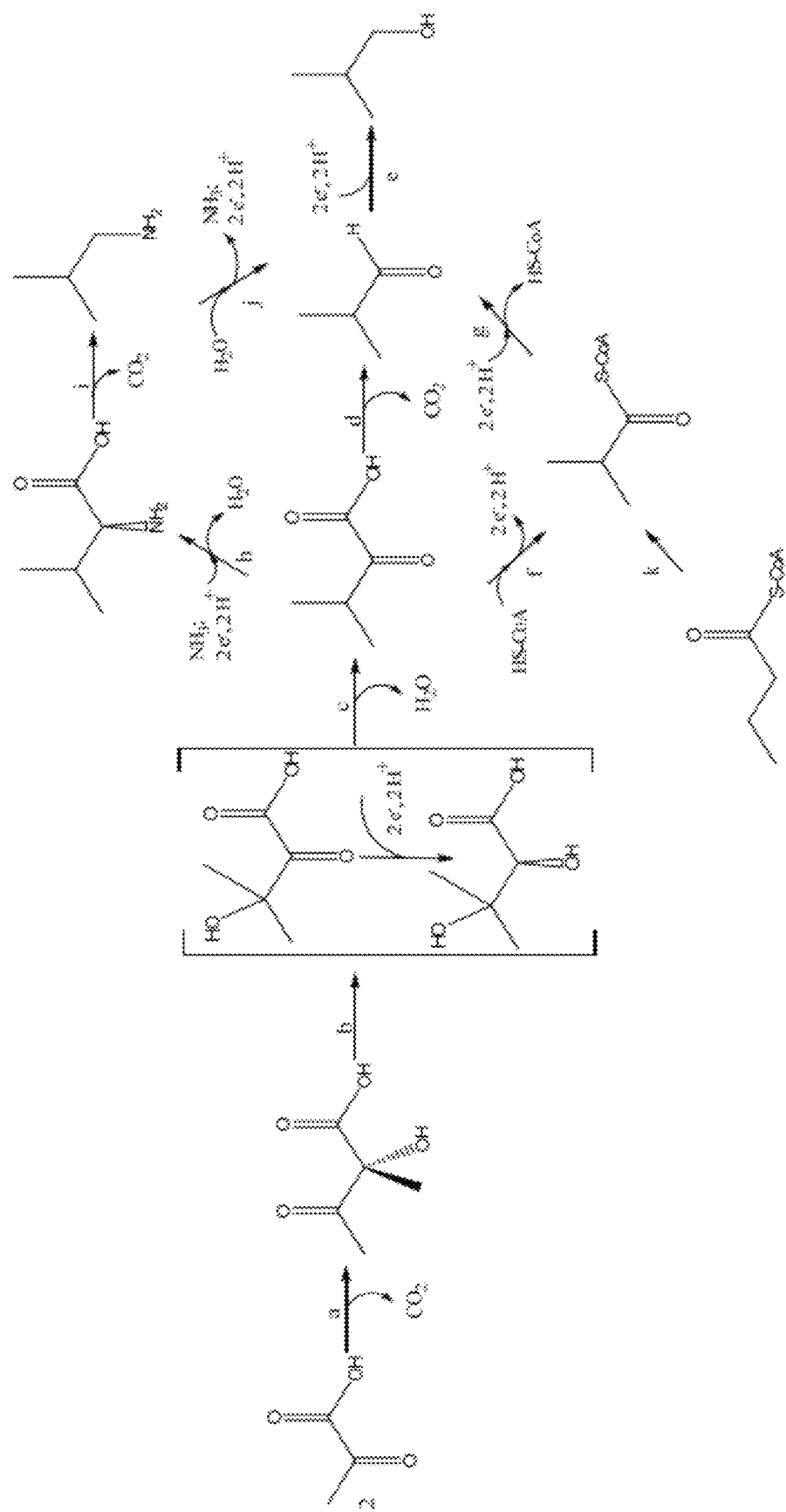
FIG. 5 depicts a biosynthetic pathway for biosynthesis of isobutanol.

The α-ketoisovalerate product of DHAD is an intermediate in isobutanol biosynthetic pathways disclosed in U.S. Patent Appl. Pub. No. 20070092957 A1, which is incorporated by reference herein. A diagram of disclosed isobutanol biosynthetic pathways is provided in FIG. 5. Production of isobutanol in a strain disclosed herein may benefit from increased DHAD activity. As disclosed herein, increased DHAD activity is provided by expression of a DHAD in a host cell, for example, by over-expressing the DHAD, by modulating the expression or activity of a polypeptide having Fe—S cluster regulatory activity, or a combination of both expression of a DHAD and modulation of the expression or activity of a polypeptide having Fe—S cluster regulatory activity. As described in U.S. Patent Appl. Pub. No. 20070092957 A1, which is incorporated by reference herein, steps in an example isobutanol biosynthetic pathway include conversion of:

pyruvate to acetolactate (see FIG. 5, pathway step a therein), as catalyzed for example by acetolactate synthase, acetolactate to 2,3-dihydroxyisovalerate (see FIG. 5, pathway step b therein) as catalyzed for example by acetohydroxy acid isomeroreductase;

2,3-dihydroxyisovalerate to α-ketoisovalerate (see FIG. 5, pathway step c therein) as catalyzed for example by acetohydroxy acid dehydratase, also called dihydroxy-acid dehydratase (DHAD);

α-ketoisovalerate to isobutyraldehyde (see FIG. 5, pathway step d therein) as catalyzed for example by branched-chain α-keto acid decarboxylase; and isobutyraldehyde to isobutanol (see FIG. 5, pathway step e therein) as catalyzed for example by branched-chain alcohol dehydrogenase.

The substrate to product conversions, and enzymes involved in these reactions, for steps f, g, h, I, j, and k of alternative pathways are described in U.S. Patent Appl. Pub. No. 20070092957 A1, which is incorporated by reference herein.

Genes that can be used for expression of the pathway step enzymes named above other than the DHADs disclosed herein, as well as those for additional isobutanol pathways, are described in U.S. Patent Appl. Pub. No. 20070092957 A1, which is incorporated by reference herein. Additional genes that may be used can be identified by one skilled in the art through bioinformatics or using methods well-known in the art, such as the various methods described in U.S. application Ser. No. 12/569,636, filed Sep. 29, 2009, which is incorporated by reference herein, to isolate homologs. Suitable ketol-acid reductoisomerase (KARL) enzymes are described in U.S. Patent Appl. Pub. Nos. 20080261230 A1, 20090163376, 20100197519, and U.S. application Ser. No. 12/893,077, all incorporated by reference herein. Examples of KARIs disclosed therein are those from *Vibrio cholerae, Pseudomonas aeruginosa* PAO1, and *Pseudomonas fluorescens* PF5. U.S. Patent Appl. Publ. No. 2009/0269823 and U.S. Prov. Patent Appl. No. 61/290,636, incorporated by reference herein, describe suitable alcohol dehydrogenases.

Additionally described in U.S. Patent Appl. Pub. No. 20070092957 A1, which is incorporated by reference herein, are construction of chimeric genes and genetic engineering of bacteria and yeast for isobutanol production using the disclosed biosynthetic pathways.

Additional Modifications

Examples of additional modifications that may be useful in cells provided herein include modifications to reduce glycerol-3-phosphate dehydrogenase activity and/or disruption in at least one gene encoding a polypeptide having pyruvate decarboxylase activity or a disruption in at least one gene encoding a regulatory element controlling pyruvate decarboxylase gene expression as described in U.S. Patent Appl.

Pub. No. 20090305363 (incorporated herein by reference), modifications to a host cell that provide for increased carbon flux through an Entner-Doudoroff Pathway or reducing equivalents balance as described in U.S. Patent Appl. Pub. No. 20100120105 (incorporated herein by reference). Other modifications include integration of at least one polynucleotide encoding a polypeptide that catalyzes a step in a pyruvate-utilizing biosynthetic pathway described in U.S. Prov. Appl. No. 61/380,563 (incorporated herein by reference). Additional modifications that may be suitable are described in U.S. application Ser. No. 12/893,089. Additionally, host cells comprising a heterologous polynucleotide encoding a polypeptide with phosphoketolase activity and host cells comprising a heterologous polynucleotide encoding a polypeptide with phosphotransacetylase activity are described in U.S. Provisional Patent Application No. 61/356,379. Growth for production Recombinant host cells disclosed herein are grown in fermentation media which contains suitable carbon substrates. Suitable carbon substrates may include, but are not limited to, monosaccharides such as glucose, fructose, oligosaccharides such as lactose maltose, galactose, or sucrose, polysaccharides such as starch or cellulose or mixtures thereof and unpurified mixtures from renewable feedstocks such as cheese whey permeate, cornsteep liquor, sugar beet molasses, and barley malt. Other carbon substrates may include ethanol, lactate, succinate, or glycerol.

Additionally the carbon substrate may also be one-carbon substrates such as carbon dioxide, or methanol for which metabolic conversion into key biochemical intermediates has been demonstrated. Two-carbon substrates such as ethanol may also be suitable. In addition to one and two carbon substrates, methylotrophic organisms are also known to utilize a number of other carbon containing compounds such as methylamine, glucosamine and a variety of amino acids for metabolic activity. For example, methylotrophic yeasts are known to utilize the carbon from methylamine to form trehalose or glycerol (Bellion et al., *Microb. Growth C1 Compd.*, [Int. Symp.], 7th (1993), 415-32, Editor(s): Murrell, J. Collin; Kelly, Don P. Publisher: Intercept, Andover, UK). Similarly, various species of *Candida* will metabolize alanine or oleic acid (Sulter et al., *Arch. Microbiol.* 153:485-489 (1990)). Hence it is contemplated that the source of carbon utilized in the present invention may encompass a wide variety of carbon containing substrates and will only be limited by the choice of organism.

Although it is contemplated that all of the above mentioned carbon substrates and mixtures thereof are suitable in the present invention, in some embodiments, the carbon substrates are glucose, fructose, and sucrose, or mixtures of these with C5 sugars such as xylose and/or arabinose for yeasts cells modified to use C5 sugars. Sucrose may be derived from renewable sugar sources such as sugar cane, sugar beets, cassava, sweet sorghum, and mixtures thereof. Glucose and dextrose may be derived from renewable grain sources through saccharification of starch based feedstocks including grains such as corn, wheat, rye, barley, oats, and mixtures thereof. In addition, fermentable sugars may be derived from renewable cellulosic or lignocellulosic biomass through processes of pretreatment and saccharification, as described, for example, in co-owned and co-pending U.S. Patent Appl. Pub. No. 20070031918 A1, which is herein incorporated by reference. Biomass refers to any cellulosic or lignocellulosic material and includes materials comprising cellulose, and optionally further comprising hemicellulose, lignin, starch, oligosaccharides and/or monosaccharides. Biomass may also comprise additional components, such as protein and/or lipid.

Biomass may be derived from a single source, or biomass can comprise a mixture derived from more than one source; for example, biomass may comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn grain, corn cobs, crop residues such as corn husks, corn stover, grasses, wheat, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers, animal manure, and mixtures thereof.

In addition to an appropriate carbon source, growth media must contain suitable minerals, salts, cofactors, buffers and other components, known to those skilled in the art, suitable for the growth of the cultures and promotion of an enzymatic pathway comprising a Fe—S cluster requiring protein such as, for example, DHAD.

Culture Conditions

Typically cells are grown at a temperature in the range of about 20° C. to about 40° C. in an appropriate medium. Suitable growth media in the present invention are common commercially prepared media such as Luria Bertani (LB) broth, Sabouraud Dextrose (SD) broth, Yeast Medium (YM) broth, or broth that includes yeast nitrogen base, ammonium sulfate, and dextrose (as the carbon/energy source) or YPD Medium, a blend of peptone, yeast extract, and dextrose in optimal proportions for growing most *Saccharomyces cerevisiae* strains. Other defined or synthetic growth media may also be used, and the appropriate medium for growth of the particular microorganism will be known by one skilled in the art of microbiology or fermentation science. The use of agents known to modulate catabolite repression directly or indirectly, e.g., cyclic adenosine 2':3'-monophosphate, may also be incorporated into the growth medium.

Suitable pH ranges for the growth are between about pH 5.0 to about pH 9.0. In one embodiment, about pH 6.0 to about pH 8.0 is used for the initial condition. Suitable pH ranges for the fermentation of yeast are typically between about pH 3.0 to about pH 9.0. In one embodiment, about pH 5.0 to about pH 8.0 is used for the initial condition. Suitable pH ranges for the fermentation of other microorganisms are between about pH 3.0 to about pH 7.5. In one embodiment, about pH 4.5 to about pH 6.5 is used for the initial condition.

Growth may be performed under aerobic or anaerobic conditions. In one embodiment, anaerobic or microaerobic conditions are used for growth.

Industrial Batch and Continuous Fermentations

Isobutanol, or other products, may be produced using a batch method of fermentation. A classical batch fermentation is a closed system where the composition of the medium is set at the beginning of the fermentation and not subject to artificial alterations during the fermentation. A variation on the standard batch system is the fed-batch system. Fed-batch fermentation processes are also suitable in the present invention and comprise a typical batch system with the exception that the substrate is added in increments as the fermentation progresses. Fed-batch systems are useful when catabolite repression is apt to inhibit the metabolism of the cells and where it is desirable to have limited amounts of substrate in the media. Batch and fed-batch fermentations are common and well known in the art and examples may be found in Thomas D. Brock in *Biotechnology: A Textbook of Industrial Microbiology*, Second Edition (1989) Sinauer Associates, Inc., Sunderland, Mass., or Deshpande, Mukund V., *Appl. Biochem. Biotechnol.*, 36:227, (1992), herein incorporated by reference.

Isobutanol, or other products, may also be produced using continuous fermentation methods. Continuous fermentation is an open system where a defined fermentation medium is added continuously to a bioreactor and an equal amount of conditioned media is removed simultaneously for processing. Continuous fermentation generally maintains the cultures at a constant high density where cells are primarily in log phase growth. Continuous fermentation allows for the modulation of one factor or any number of factors that affect cell growth or end product concentration. Methods of modulating nutrients and growth factors for continuous fermentation processes as well as techniques for maximizing the rate of product formation are well known in the art of industrial microbiology and a variety of methods are detailed by Brock, supra.

It is contemplated that the production of isobutanol, or other products, may be practiced using batch, fed-batch or continuous processes and that any known mode of fermentation would be suitable. Additionally, it is contemplated that cells may be immobilized on a substrate as whole cell catalysts and subjected to fermentation conditions for isobutanol production.

Methods for Isobutanol Isolation from the Fermentation Medium

Bioproduced isobutanol may be isolated from the fermentation medium using methods known in the art for ABE fermentations (see, e.g., Durre, *Appl. Microbiol. Biotechnol.* 49:639-648 (1998), Groot et al., *Process. Biochem.* 27:61-75 (1992), and references therein). For example, solids may be removed from the fermentation medium by centrifugation, filtration, decantation, or the like. Then, the isobutanol may be isolated from the fermentation medium using methods such as distillation, azeotropic distillation, liquid-liquid extraction, adsorption, gas stripping, membrane evaporation, or pervaporation.

Because isobutanol forms a low boiling point, azeotropic mixture with water, distillation can be used to separate the mixture up to its azeotropic composition. Distillation may be used in combination with another separation method to obtain separation around the azeotrope. Methods that may be used in combination with distillation to isolate and purify butanol include, but are not limited to, decantation, liquid-liquid extraction, adsorption, and membrane-based techniques. Additionally, butanol may be isolated using azeotropic distillation using an entrainer (see, e.g., Doherty and Malone, *Conceptual Design of Distillation Systems*, McGraw Hill, New York, 2001).

The butanol-water mixture forms a heterogeneous azeotrope so that distillation may be used in combination with decantation to isolate and purify the isobutanol. In this method, the isobutanol containing fermentation broth is distilled to near the azeotropic composition. Then, the azeotropic mixture is condensed, and the isobutanol is separated from the fermentation medium by decantation. The decanted aqueous phase may be returned to the first distillation column as reflux. The isobutanol-rich decanted organic phase may be further purified by distillation in a second distillation column.

The isobutanol may also be isolated from the fermentation medium using liquid-liquid extraction in combination with distillation. In this method, the isobutanol is extracted from the fermentation broth using liquid-liquid extraction with a suitable solvent. The isobutanol-containing organic phase is then distilled to separate the butanol from the solvent.

Distillation in combination with adsorption may also be used to isolate isobutanol from the fermentation medium. In this method, the fermentation broth containing the isobutanol is distilled to near the azeotropic composition and then the remaining water is removed by use of an adsorbent, such as molecular sieves (Aden et al. *Lignocellulosic Biomass to Ethanol Process Design and Economics Utilizing Co-Current Dilute Acid Prehydrolysis and Enzymatic Hydrolysis for Corn Stover*, Report NREL/TP-510-32438, National Renewable Energy Laboratory, June 2002).

Additionally, distillation in combination with pervaporation may be used to isolate and purify the isobutanol from the fermentation medium. In this method, the fermentation broth containing the isobutanol is distilled to near the azeotropic composition, and then the remaining water is removed by pervaporation through a hydrophilic membrane (Guo et al., *J. Membr. Sci.* 245, 199-210 (2004)).

Embodiments of the Inventions

Embodiment 1 (E1). A recombinant host cell comprising at least one heterologous polynucleotide encoding a polypeptide having dihydroxy-acid dehydratase activity wherein said at least one heterologous polynucleotide comprises a high copy number plasmid or a plasmid with a copy number that can be regulated.

E2. A recombinant host cell comprising at least one heterologous polynucleotide encoding a polypeptide having dihydroxy-acid dehydratase activity wherein said at least one heterologous polynucleotide is integrated at least once in the recombinant host cell DNA.

E3. A recombinant host cell comprising at least one heterologous polynucleotide encoding a polypeptide having dihydroxy-acid dehydratase activity, wherein said host cell comprises at least one deletion, mutation, and/or substitution in an endogenous gene encoding a polypeptide affecting Fe—S cluster biosynthesis.

E4. A recombinant host cell comprising at least one heterologous polynucleotide encoding a polypeptide having dihydroxy-acid dehydratase activity and at least one heterologous polynucleotide encoding a polypeptide affecting Fe—S cluster biosynthesis.

E5. The recombinant host cell of any one of embodiments E3-E4, wherein said heterologous polynucleotide encoding a polypeptide affecting Fe—S cluster biosynthesis is selected from the group consisting of the genes in Tables 8 and 9.

E6. The recombinant host cell of any one of embodiments E3-E4, wherein said heterologous polynucleotide encoding a polypeptide affecting Fe—S cluster biosynthesis is selected from the group consisting of the genes in Table 7.

E7. The recombinant host cell of embodiment E5 or E6, wherein said heterologous polynucleotide encoding a polypeptide affecting Fe—S cluster biosynthesis is selected from the group consisting of AFT1, AFT2, PSE1, FRA2, GRX3, MSN5. and combinations thereof.

E8. The recombinant host cell of embodiment E7, wherein said polypeptide is encoded by a polynucleotide that is constitutive mutant.

E9. The recombinant host cell of embodiment E8, wherein said constitutive mutant is selected from the group consisting of AFT1 L99A, AFT1 L102A, AFT1 C291F, AFT1 C293F, and combinations thereof.

E10. The recombinant host cell of embodiment E7, wherein said polypeptide affecting Fe—S cluster biosynthesis is encoded by a polynucleotide comprising a high copy number plasmid or a plasmid with a copy number that can be regulated.

E11. The recombinant host cell of embodiment E7, wherein said polypeptide affecting Fe—S cluster biosynthesis is encoded by a polynucleotide integrated at least once in the recombinant host cell DNA.

E12. The recombinant host cell of embodiment E3, wherein the at least one deletion, mutation, and/or substitution in an endogenous gene encoding a polypeptide affecting Fe—S cluster biosynthesis is selected from the group consisting of FRA2, GRX3, MSN5, and combinations thereof.

E13. The recombinant host cell of embodiment E4, wherein the at least one heterologous polynucleotide encoding a polypeptide affecting Fe—S cluster biosynthesis is selected from the group consisting of AFT1, AFT2, PSE1, and combinations thereof.

E14. The recombinant host cell of any one of embodiments E3-E13, wherein said at least one heterologous polynucleotide encoding a polypeptide having dihydroxy-acid dehydratase activity is expressed in multiple copies.

E15. The recombinant host cell of embodiment E14, wherein said at least one heterologous polynucleotide comprises a high copy number plasmid or a plasmid with a copy number that can be regulated.

E16. The recombinant host cell of embodiment E14, wherein said at least one heterologous polynucleotide is integrated at least once in the recombinant host cell DNA.

E17. The recombinant host cell of any one of embodiments E3-E16, wherein said Fe—S cluster biosynthesis is increased compared to a recombinant host cell having endogenous Fe—S cluster biosynthesis.

E18. The recombinant host cell of any one of embodiments E1-E17, wherein said host cell is a yeast host cell.

E19. The recombinant host cell of embodiment E18, wherein said yeast host cell is selected from the group consisting of *Saccharomyces, Schizosaccharomyces, Hansenula, Candida, Kluyveromyces, Yarrowia, Issatchenkia* and *Pichia*.

E20. The recombinant host cell of any one of embodiments E1-E19, wherein said heterologous polypeptide having dihydroxy-acid dehydratase activity is expressed in the cytosol of the host cell.

E21. The recombinant host cell of any one of embodiments E1-E20, wherein said heterologous polypeptide having dihydroxy-acid dehydratase activity has an amino acid sequence that matches the Profile HMM of Table 12 with an E value of $<10^{-5}$ wherein the polypeptide further comprises all three conserved cysteines, corresponding to positions 56, 129, and 201 in the amino acids sequences of the *Streptococcus mutans* DHAD enzyme corresponding to SEQ ID NO:168.

E22. The recombinant host cell of any one of embodiments E1-E21, wherein said heterologous polypeptide having dihydroxy-acid dehydratase activity has an amino acid sequence with at least about 90% identity to SEQ ID NO: 168 or SEQ ID NO: 232.

E23. The recombinant host cell of any one of embodiments E1-E22, wherein said polypeptide having dihydroxy-acid dehydratase activity has a specific activity selected from the group consisting of:
   a. greater than about 5-fold with respect to the control host cell comprising at least one heterologous polynucleotide encoding a polypeptide having dihydroxy-acid dehydratase activity;
   b. greater than about 8-fold with respect to the control host cell comprising at least one heterologous polynucleotide encoding a polypeptide having dihydroxy-acid dehydratase activity; and
   c. greater than about 10-fold with respect to the control host cell comprising at least one heterologous polynucleotide encoding a polypeptide having dihydroxy-acid dehydratase activity.

E24. The recombinant host cell of any one of embodiments E1-E22, wherein said polypeptide having dihydroxy-acid dehydratase activity has a specific activity selected from the group consisting of:
   a. greater than about 0.25 U/mg;
   b. greater than about 0.3 U/mg;
   c. greater than about 0.5 U/mg;
   d. greater than about 1.0 U/mg;
   e. greater than about 1.5 U/mg;
   f. greater than about 2.0 U/mg;
   g. greater than about 3.0 U/mg;
   h. greater than about 4.0 U/mg;
   i. greater than about 5.0 U/mg;
   j. greater than about 6.0 U/mg;
   k. greater than about 7.0 U/mg;
   l. greater than about 8.0 U/mg;
   m. greater than about 9.0 U/mg;
   n. greater than about 10.0 U/mg;
   o. greater than about 20.0 U/mg; and
   p. greater than about 50.0 U/mg.

E25. The recombinant host cell of any one of embodiments E1-E24, wherein said recombinant host cell produces isobutanol.

E26. The recombinant host cell of embodiment E25, wherein said recombinant host cell comprises an isobutanol biosynthetic pathway.

E27. A method of making a product comprising:
   a. providing the recombinant host cell of any one of embodiments E1-E24; and
   b. contacting the recombinant host cell of (a) with a fermentable carbon substrate in a fermentation medium under conditions wherein said product is produced;
wherein the product is selected from the group consisting of branched chain amino acids, pantothenic acid, 2-methyl-1-butanol, 3-methyl-1-butanol, isobutanol, and combinations thereof.

E28. A method of making isobutanol comprising:
   a. providing the recombinant host cell of any one of embodiments E1-E24;
   b. contacting the recombinant host cell of (a) with a fermentable carbon substrate in a fermentation medium under conditions wherein isobutanol is produced.

E29. A method for the conversion of 2,3-dihydroxyisovalerate to α-ketoisovalerate comprising:
   a. providing the recombinant host of any one of embodiments E1-E24;
   b. growing the recombinant host cell of (a) under conditions where the 2,3-dihydroxyisovalerate is converted to α-ketoisovalerate,
wherein 2,3-dihydroxyisovalerate is converted to α-ketoisovalerate.

E30. A method for increasing the specific activity of a heterologous polypeptide having dihydroxy-acid dehydratase activity in a recombinant host cell comprising:
   a. providing a recombinant host cell of any one of embodiments E1-E24; and
   b. growing the recombinant host cell of (a) under conditions whereby the heterologous polypeptide having dihydroxy-acid dehydratase activity is expressed in functional form having a specific activity greater than the same host cell lacking said heterologous polypeptide.

E31. A method for increasing the flux in an Fe—S cluster biosynthesis pathway in a host cell comprising:
   a. providing a recombinant host cell of any one of embodiments E3-E24; and b. growing the recombinant host cell of (a) under conditions whereby the flux in the Fe—S cluster biosynthesis pathway in the host cell is increased.

E32. A method of increasing the activity of an Fe—S cluster requiring protein in a recombinant host cell comprising:
  a. providing a recombinant host cell comprising an Fe—S cluster requiring protein;
  b. changing the expression or activity of a polypeptide affecting Fe—S cluster biosynthesis in said host cell; and
  c. growing the recombinant host cell of (b) under conditions whereby the activity of the Fe—S cluster requiring protein is increased.

E33. The method of embodiment E32, wherein said increase in activity is an amount selected from the group consisting of:
  a. greater than about 10%;
  b. greater than about 20%;
  c. greater than about 30%;
  d. greater than about 40%;
  e. greater than about 50%;
  f. greater than about 60%;
  g. greater than about 70%;
  h. greater than about 80%;
  i. greater than about 90%; and
  j. greater than about 95%.

E34. The method of embodiment E32, wherein said increase in activity is an amount selected from the group consisting of:
  a. greater than about 5 fold;
  b. greater than about 8 fold;
  c. greater than about 10 fold.

E35. A method for identifying polypeptides that increase the flux in an Fe—S cluster biosynthesis pathway in a host cell comprising:
  a. changing the expression or activity of a polypeptide affecting Fe—S cluster biosynthesis;
  b. measuring the activity of a heterologous Fe—S cluster requiring protein; and
  c. comparing the activity of the heterologous Fe—S cluster requiring protein measured in the presence of the changed expression or activity of a polypeptide of step (a) to the activity of the heterologous Fe—S cluster requiring protein measured in the absence of the changed expression or activity of a polypeptide of step (a),
wherein an increase in the activity of the heterologous Fe—S cluster requiring protein indicates an increase in the flux in said Fe—S cluster biosynthesis pathway.

E36. A method for identifying polypeptides that increase the flux in an Fe—S cluster biosynthesis pathway in a host cell comprising:
  a. changing the expression or activity of a polypeptide affecting Fe—S cluster biosynthesis;
  b. measuring the activity of a polypeptide having dihydroxy-acid dehydratase activity; and
  c. comparing the activity of the polypeptide having dihydroxy-acid dehydratase activity measured in the presence of the change in expression or activity of a polypeptide of step (a) to the activity of the polypeptide having dihydroxy-acid dehydratase activity measured in the absence of the change in expression or activity of a polypeptide of step (a),
wherein an increase in the activity of the polypeptide having dihydroxy-acid dehydratase activity indicates an increase in the flux in said Fe—S cluster biosynthesis pathway.

E37. The method of any one of embodiments E30-E36, wherein said changing the expression or activity of a polypeptide affecting Fe—S cluster biosynthesis comprises deleting, mutating, substituting, expressing, up-regulating, down-regulating, altering the cellular location, altering the state of the protein, and/or adding a cofactor.

E38. The method of any one of embodiments E32-E37, wherein the Fe—S cluster requiring protein has dihydroxy-acid dehydratase activity and wherein said Fe—S cluster requiring protein having dihydroxy-acid dehydratase activity has an amino acid sequence that matches the Profile HMM of Table 12 with an E value of $<10^{-5}$ wherein the polypeptide further comprises all three conserved cysteines, corresponding to positions 56, 129, and 201 in the amino acids sequences of the *Streptococcus mutans* DHAD enzyme corresponding to SEQ ID NO:168.

E39. The method of any one of embodiments E32-E38, wherein said polypeptide affecting Fe—S cluster biosynthesis is selected from the group consisting of the genes in Tables 7, 8 and 9.

E40. A recombinant host cell comprising at least one polynucleotide encoding a polypeptide identified by the methods of any one of embodiments E35-E37.

E41. The recombinant host cell of embodiment E40, wherein said host cell further comprises at least one heterologous polynucleotide encoding a polypeptide having dihydroxy-acid dehydratase activity.

E42. The recombinant host cell of embodiment E41, wherein said heterologous polynucleotide encoding a polypeptide having dihydroxy-acid dehydratase activity is expressed in multiple copies.

E43. The recombinant host cell of embodiment E41, wherein said heterologous polynucleotide comprises a high copy number plasmid or a plasmid with a copy number that can be regulated.

E44. The recombinant host cell of embodiment E41, wherein said heterologous polynucleotide is integrated at least once in the recombinant host cell DNA.

E45. The method of embodiment E35 or E36, wherein said host cell is a yeast host cell.

E46. The method of embodiment E45, wherein said yeast host cell is selected from the group consisting of *Saccharomyces, Schizosaccharomyces, Hansenula, Candida, Kluyveromyces, Yarrowia, Issatchenkia,* and *Pichia.*

E47. The method of any one of embodiments E28-E39, wherein said host cell is a yeast host cell.

E48. The method of embodiment E47, wherein said yeast host cell is selected from the group consisting of *Saccharomyces, Schizosaccharomyces, Hansenula, Candida, Kluyveromyces, Yarrowia, Issatchenkia,* and *Pichia.*

E49. The recombinant host cell of any one of embodiments E40-E44, wherein said recombinant host cell is a yeast host cell.

E50. The recombinant host cell of embodiment E49, wherein said yeast host cell is selected from the group consisting of *Saccharomyces, Schizosaccharomyces, Hansenula, Candida, Kluyveromyces, Yarrowia, Issatchenkia,* and *Pichia.*

E51. The recombinant host cell of any one of embodiments E40-E44 or E49-E50, wherein said heterologous polypeptide having dihydroxy-acid dehydratase activity is expressed in the cytosol of the host cell.

E52. The recombinant host cell of any one of embodiments E40-E44 or E49-E50, wherein said heterologous polypeptide having dihydroxy-acid dehydratase activity has an amino acid sequence that matches the Profile HMM of Table 12 with an E value of $<10^{-5}$ wherein the polypeptide further comprises all three conserved cysteines, corresponding to positions 56, 129, and 201 in the amino acids sequences of the *Streptococcus mutans* DHAD enzyme corresponding to SEQ ID NO:168.

E53. The recombinant host cell of any one of embodiments E40-E44 or E49-E50, wherein said recombinant host cell produces a product selected from the group consisting of branched chain amino acids, pantothenic acid, 2-methyl-1-butanol, 3-methyl-1-butanol, isobutanol, and combinations thereof.

E54. The recombinant host cell of embodiment E53, wherein said recombinant host cell produces isobutanol.

E55. The recombinant host cell of embodiment E54, wherein said recombinant host cell comprises an isobutanol biosynthetic pathway.

EXAMPLES

The meaning of abbreviations used is as follows: "min" means minute(s), "h" means hour(s), "sec" means second(s), "µl" means microliter(s), "ml" means milliliter(s), "L" means liter(s), "nm" means nanometer(s), "mm" means millimeter(s), "cm" means centimeter(s), "µm" means micrometer(s), "mM" means millimolar, "M" means molar, "mmol" means millimole(s), "µmole" means micromole(s), "g" means gram(s), "µg" means microgram(s), "mg" means milligram(s), "rpm" means revolutions per minute, "w/v" means weight/volume, "OD" means optical density, and "$OD_{600}$" means optical density measured at a wavelength of 600 nm.

General Methods:

Standard recombinant DNA and molecular cloning techniques used in the Examples are well known in the art and are described by Sambrook, J., Fritsch, E. F. and Maniatis, T., *Molecular Cloning: A Laboratory Manual*, Cold Spring Harbor Laboratory Press, Cold Spring Harbor, N.Y., 1989, by T. J. Silhavy, M. L. Bennan, and L. W. Enquist, *Experiments with Gene Fusions*, Cold Spring Harbor Laboratory, Cold Spring Harbor, N.Y., 1984, and by Ausubel, F. M. et al., *Current Protocols in Molecular Biology*, Greene Publishing Assoc. and Wiley-Interscience, N.Y., 1987.

Materials and methods suitable for the maintenance and growth of bacterial cultures are also well known in the art. Techniques suitable for use in the following Examples may be found in *Manual of Methods for General Bacteriology*, Phillipp Gerhardt, R. G. E. Murray, Ralph N. Costilow, Eugene W. Nester, Willis A. Wood, Noel R. Krieg and G. Briggs Phillips, eds., American Society for Microbiology, Washington, D.C., 1994, or by Thomas D. Brock in *Biotechnology: A Textbook of Industrial Microbiology*, Second Edition, Sinauer Associates, Inc., Sunderland, Mass., 1989. All reagents, restriction enzymes and materials used for the growth and maintenance of bacterial cells were obtained from Aldrich Chemicals (Milwaukee, Wis.), BD Diagnostic Systems (Sparks, Md.), Life Technologies (Rockville, Md.), or Sigma Chemical Company (St. Louis, Mo.), unless otherwise specified.

Example 1

Over-Expression of DHAD Protein Encoded by the ilvD Gene from *S. mutans* Using a Plasmid-based System in Yeast Cytosol Over-expression of a recombinant polynucleotide can be accomplished by increasing the copy number of a plasmid comprising the recombinant polynucleotide. To over-express the DHAD protein in yeast, an inducible vector was constructed. The pHR81 vector contains a Ura3 marker as well as a LEU marker with a defective promoter (see U.S. Patent Appl. Pub. No. 2007/0092957, which is incorporated by reference herein). When the yeast synthetic dropout (SD; also known as complete minimal media; Teknova) growth medium is switched from SD minus uracil to SD minus leucine, the copy number of the pHR81 plasmid increases, resulting in much higher level of expression of the recombinant polynucleotide. The pHR81 vector backbone was derived from pLH472 JEG4y (SEQ ID NO: 921) and was prepared by digesting the pLH472 JEG4y vector with SpeI and SacII.

For over-expression of a DHAD protein, the DHAD gene ilvD from *S. mutans* (SEQ ID NO:167) was used (see U.S. Published Patent Appl. No. US2009-0305363A1, which is incorporated by reference herein). This gene has been cloned under the control of the FBA promoter in vector pRS423 FBA ilvD Strep-lumio (see U.S. Published Patent Appl. No. US2009-0305363A1, which is incorporated by reference herein). The region containing the FBA promoter, the ilvD gene, and FBA terminator cassette was amplified with primer set FBAp-F(NheI) and FBAt-R(SacII) (SEQ ID NOs: 915 and 916) and cloned into the pHR81 vector. The resulting expression vector was designated as pHR81 FBA-IlvD(Sm) (SEQ ID NO: 917; FIG. 1A).

To over express the *S. mutans* DHAD protein, the expression vector pHR81 FBA-IlvD(Sm) was transformed into wild-type yeast strain BY4741. Transformants were selected on agar plates with SD minus uracil. For over-expression, yeast strains containing the plasmid were initially grown at 30° C. in SD liquid medium minus uracil. A fresh overnight culture (5 ml) was then transferred to a 125 ml flask containing 75 ml of SD medium minus leucine. As a control, another 5 ml of fresh overnight culture was transferred into a flask containing 75 ml of SD minus uracil. The cultures were incubated overnight before harvesting by centrifugation. The DHAD activity was measured in crude extracts of these samples using the assay described in Example 7.

The DHAD specific activity obtained in the crude extract in the control samples grown in SD minus uracil was in the range of 0.2 to 0.3 U mg$^{-1}$. The average specific activity obtained from strains grown in the SD medium minus leucine, however, was 1.6 U mg$^{-1}$, much higher (~5 to 8-fold higher) than the activity from the control samples. DHAD requires Fe—S cluster for its function, and it was not previously known if the native yeast Fe—S cluster biosynthesis pathway could accommodate an over-expressed Fe—S cluster requiring protein in yeast cytosol. In a previous screening experiment using a non-inducible, low-copy number vector, the DHAD from *S. mutans* could be recombinantly expressed in yeast cytosol with a specific activity in the range of 0.1 to 0.2 U mg$^{-1}$ in the crude extract (see U.S. patent application Ser. No. 12/569,636, filed on Sep. 29, 2009, which is incorporated by reference herein). Thus, in one embodiment, over-expression of a Fe—S cluster requiring protein, such as DHAD, in yeast using a high-copy number vector provides increased specific activity, wherein the specific activity is increased by at least about 5-fold to at least about 8-fold.

Example 2

Figure 1B:
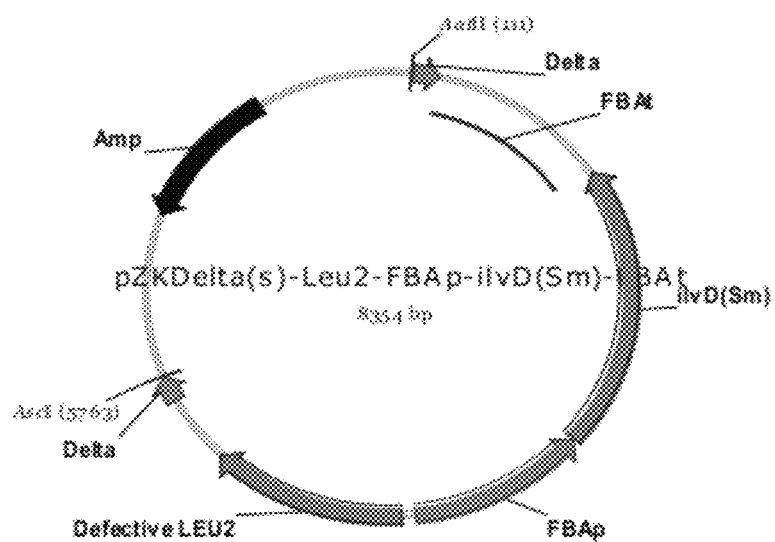
FIG. 1B depicts a vector map of an integration vector for overexpression of the IlvD gene from S. mutans in the chromosome.

Over-Expression of DHAD Protein Encoded by the ilvD Gene from *S. mutans* Through Chromosomal Integration An alternate way to increase the expression of a gene in yeast is to integrate multiple copies of the gene of interest into the host cell's chromosome. To integrate the ilvD gene from S. mutans (SEQ ID NO:167) into a yeast chromosome, integration vector pZK-Delta(s)-Leu2-FBA-ilvD(Sm)-FBAt (SEQ ID NO: 918; FIG. 1B) was constructed. The integration vector backbone was derived from pSuperscript (Stratagene, La Jolla, Calif.). The S. mutans ilvD gene (nucleotides 1306-3018 of the complement strand) was cloned into the integration vector under the control of the FBA promoter (nucleotides 3026-4023 of the complement strand) so that the ilvD gene would be flanked by a yeast delta sequence (nucleotides 118-267 and 5061-5760 of the complement strand). S. cerevisiae contains more than 200 yeast delta sequences (Kim J M et al. Genome Res. 1998; 8:464-478). These delta sequences are targets for multiple integrations. The integration vector was also engineered to contain the defective LEU2 marker (nucleotides 4100-5191 of the complement strand) for selection of transformed strains with multiple integration events.

For integration, the vector DNA was linearized with AscI and AatII digestion to generate delta sequence flanked strands of vector DNA comprising the ilvD gene, which were then transformed into the yeast strain BY4741. Transformants were selected on SD agar medium minus leucine. These transformants were then grown on SD liquid medium minus leucine at 30° C., and the cultures were harvested and analyzed for DHAD activity. The specific activity of DHAD obtained in the crude extract ranged from 0.7 to 1.2 U mg$^{-1}$. This specific activity was about 3- to 6-fold higher than that found in BY4741 strains transformed with an ilvD gene-containing plasmid without over-expression Example 3

Improvement of Specific Activity of DHAD in Yeast Deletion Strains

Although the over-expression strains described in Examples 1 and 2 had a high level of activity, not all of the DHAD protein expressed was active. For example, the over-expressed DHAD protein accounted for approximately 5 to 10% of the total cell protein, while yielding a specific activity of from about 0.7 to 1.6 U mg$^{-1}$. Given that the specific activity of the purified DHAD enzyme from S. mutans is 100 U mg$^{-1}$, expression of DHAD at 10% of total cell protein would be expected to yield a specific activity upwards of 5 to 10 U mg$^{-1}$. Although not wishing to be bound by one theory, the difference between the expected and observed specific activity was likely a result of insufficient Fe—S cluster loading. Thus, increasing Fe—S cluster loading by further manipulating the over-expression strains could be used to increase the specific activity of DHAD.

In order to improve the specific activity, yeast strains with deletions in genes involved in iron metabolism and Fe—S cluster sensing were used to investigate their effects on DHAD specific activity. These strains (BY4741 background) were purchased from Open Biosystem (Huntsville, Ala.) and are listed in Table 10. As described in Example 1, the high copy number plasmid pHR81 FBA-IlvD(Sm) was transformed into these strains, and DHAD over-expression was induced by changing the growth medium to SD minus leucine. Crude extracts from cultures were prepared and assayed for DHAD activity. Results are shown in Table 10.

TABLE 10

Effects of deletions of genes involved in Fe metabolism.

| Genes | Function | Specific Activity (U/mg) |
|---|---|---|
| WT | | 1.69 ± 0.02 |
| Δisu1 | scaffold protein for Fe—S cluster assembling | 1.31 ± 0.56 |
| Δfra2 | repressor component for Aft1p | 3.41 ± 0.24 |
| Δsin4 | regulatory protein | 1.65 ± 0.20 |
| Δmtm1 | protein involved in metal metabolism | 0.54 ± 0.12 |
| Δfra1 | regulatory protein | 0.97 ± 0.05 |
| Δgrx3 | glutaredoxins | 5.45 ± 0.14 |
| Δaft1 | global Fe regulator | 0.23 ± 0.05 |
| Δaft2 | paralogue to Aft1p | 1.11 ± 0.38 |
| Δmsn5 | nuclear protein exporter | 1.59 ± 0.10 |
| Δfet3 | ferrous iron uptake; multi-copper oxidase | 0.54 ± 0.09 |
| Δftr1 | ferrous iron uptake; permease | 0.76 ± 0.03 |
| Δccc2 | copper transporter (for Fet3p) | 1.23 ± 0.17 |
| Δgef1 | copper transporter/loading for Fet3p | 1.70 ± 0.10 |
| Δfet4 | Low-affinity Fe(II) transporter | 1.07 ± 0.02 |
| Δsmf1 | Low-affinity Fe(II) transporter | 1.78 ± 0.12 |
| Δmrs3 | mitochondrial iron transporter | 1.51 ± 0.13 |
| Δmrs4 | mitochondrial iron transporter | 0.85 ± 0.16 |
| Δcth2 | targeted mRNA binding and degradation | 1.28 ± 0.40 |
| Δcth1 | targeted mRNA binding and degradation | 1.44 ± 0.30 |

Surprisingly, DHAD specific activity in the crude extract in strains with a deletion in either the FRA2 or the GRX3 gene increased by 2- to 3-fold, which was unexpected as many of the deletions tested did not increase DHAD specific activity. It has been shown that cytosolic iron sulfur assembly (CIA) machinery in yeast is responsible for assembly of Fe—S clusters for cytosolic proteins such as isopropylmalate isomerase (Leu1). Previous results indicate that this CIA machinery is independent from the iron sensing system involving Aft1 and a Grx3/Grx4-Fra2 heterodimer as the repressor (Rutherford et al, J Biol Chem. 280:10135-10140 (2005)).

Another unexpected finding is the effect of a Grx3 deletion on DHAD activity. It has been shown that Grx3 and Grx4 are equivalent in function. While double mutations in both GRX3 and GRX4 genes resulted in drastic activation of the Fe regulon, mutation in Grx4 alone confers minimal phenotype (Pujol-Carrion, et al, J Cell Sci. 119:4554-4564 (2006); Ojeda, et al, J Biol Chem. 281:17661-17669 (2006).). As shown in Table 10 above, GRX3 deletion alone leads to significant improvement in DHAD specific activity.

Figure 10:
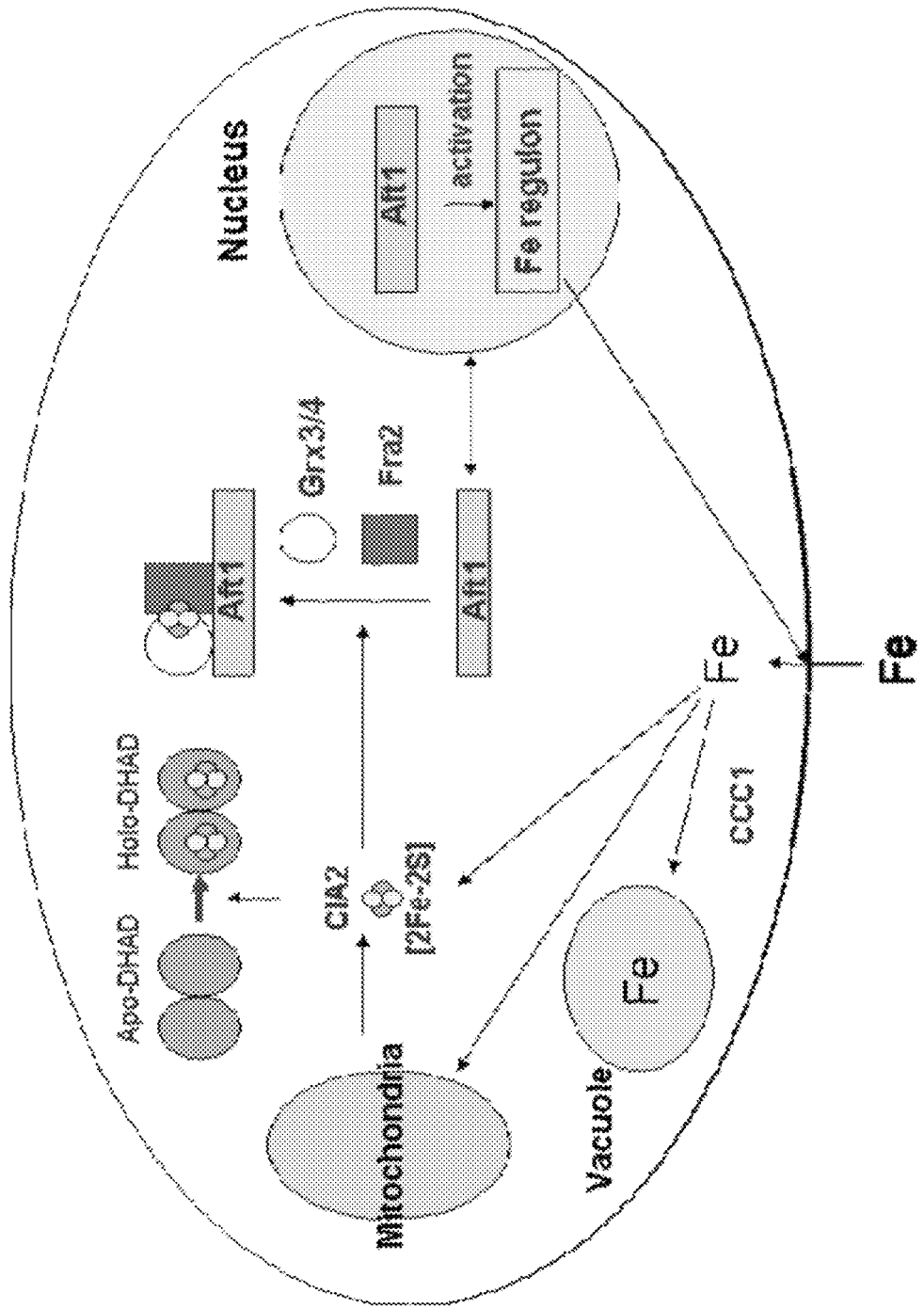
FIG. 10 depicts a schematic of the cytosolic [2Fe-2S] biosynthesis and assembly system.

Thus, these results demonstrate that modulating genes involved in iron metabolism can increase the activity of an Fe—S cluster requiring protein such as DHAD when expressed in yeast cytosol. As outlined in FIG. 10, the effect of deletions of the FRA2 and GRX3 genes on DHAD specific activity could result from, e.g., activation of transcription of one or more of the genes in the iron regulon via the global regulator Aft1p. Although not wishing to be bound by any one theory, activation of such genes could lead to an increase in iron uptake and an increase in cytoplasmic Fe—S cluster biosynthesis, leading to higher Fe—S cluster loading of the protein (FIG. 10). Demonstration of increased Fe—S cluster loading is described in Example 11.

Example 4

Effect of Expression of Aft1p and its Mutants on DHAD Specific Activity

As described in Example 3 and outlined in FIG. 10, Fra2, Grx3, and Grx4 are repressors that regulate the function of Aft1p (Kumánovics, et al., J. Biol. Chem. 283:10276-10286

(2008)). Aft1p is a global regulator of iron. Activation of genes involved in iron uptake and metabolism requires the nuclear localization of Aft1p. Expression of Aft1 constitutive mutants or an increase in the expression of wild-type Aft1p, could lead to the activation of the Fe regulon in a wild-type strain or in an AFT1 deletion strain (Yamaguchi-Iwai, et al, *EMBO J.* 14:1231-1239 (1995); Yamaguchi-Iwai, et al, *J. Biol. Chem.* 277:18914-18918 (2002); Kaplan, et al, *Chem. Rev.* 109:4536-4552 (2009)). Based on the novel findings described in Example 3, it is possible that expression of Aft1p protein and its constitutive mutants may improve the active fraction of the DHAD enzyme which requires Fe—S clusters for its activity.

Figure 2:
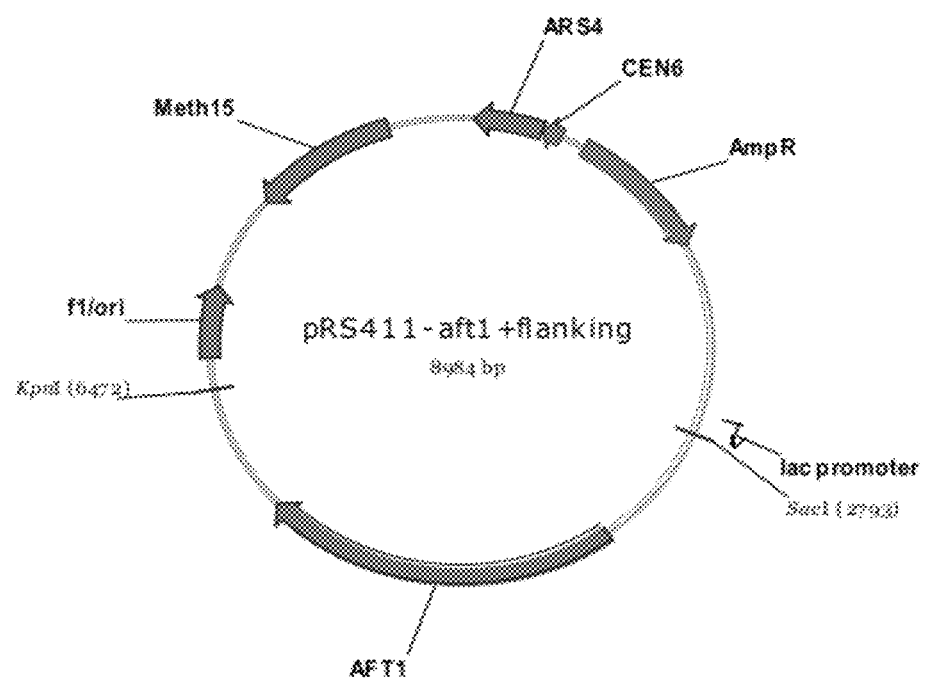
FIG. 2 depicts a vector map of a centromere vector used to clone AFT1 or AFT1 mutants and useful for other genes of interest.

To examine this possibility, the wild-type AFT1 gene and its constitutive mutants were cloned using a centromere vector pRS411 (ATCC® Number: 87538; SEQ ID NO: 919). This vector has an ampicillin selection marker for growth in *E. coli* and a methionine nutritional marker for selection in yeast. The wild-type AFT1 gene, including its own promoter and terminator, can be cloned between the KpnI and SacI sites, resulting in the construct pRS411-Aft1+flanking (SEQ ID NO: 920; FIG. 2). A similar strategy can be used to clone genes that encode Aft1 constitutive mutants. The Aft1 constitutive mutants with substitutions at amino acids L99 to A and C291 to F (with respect to SEQ ID NO: 703) were first examined. The pRS411 constructs with genes encoding the wild-type AFT1 gene or constitutive mutants were transformed, along with the expression vector pHR81 FBA IlvD (Sm), into the wild-type yeast strain BY4741 or a yeast strain with a deletion in AFT1, GRX3, or FRA2. Transformants were selected on agar plates with SD medium minus methionine and uracil. Transformed strains were grown in SD medium minus methionine and leucine to over-express the DHAD protein in the presence of these genes or mutants. The DHAD activity in the crude extract of these cultures were measured.

Results of expression of wild-type Aft1p, Aft1p(C291F), and Aft1p(L99A) are shown in Table 11. A moderate increase in DHAD specific activity was observed with Aft1p (C291F) as compared to wild-type Aft1p. A much higher increase in DHAD activity was observed with Aft1p(L99A). The specific activity of DHAD in yeast expressing Aft1p(L99A) was similar to the specific activity obtained in the GRX3 deletion strain (see Table 10).

TABLE 11

Effects of expression of Aft1p and its mutants on the activity of DHAD from *S. mutans* in Δaft1 strain.

| Plasmids | Specific Activity (U/mg) |
|---|---|
| pHR81-FBA-ilvD(Sm) + pRS411-Aft1 | 2.60 ± 0.52 |
| pHR81-FBA-ilvD(Sm) + pRS411-Aft1(C291L) | 3.79 ± 0.23 |
| pHR81-FBA-ilvD(Sm) + pRS411-Aft1(L99A) | 5.41 ± 0.41 |

Example 5

Increase in Cytosolic DHAD Specific Activity in a CCC1 Deletion Strain

The exact mechanism of increasing Fe—S cluster biosynthesis capability for cytosolic DHAD protein is unknown. Based on the findings with FRA2 and GRX3 deletion strains (Example 3) and with expression of Aft1p mutants (Example 4), increasing the availability of the Fe content in the cytosol may also improve the DHAD specific activity. CCC1 deletion has been shown to increase the Fe content of the cytosol (Li L, et al, *J Biol Chem.* 276:29515-29519 (2001)). To test this hypothesis, the CCC1 deletion strain of BY4741 was transformed with plasmid pHR81 FBA-IlvD(Sm) as described in Example 1. The crude extracts of cells with the plasmid were assayed for DHAD activity. Table 13 shows the results of the experiment. When the CCC1 deletion strain with the DHAD plasmid was grown in SD medium lacking uracil, an increase in DHAD specific activity was found as compared to the wild-type cells with the same plasmid. When extra Fe was added, a further increase in DHAD was observed in the CCC1 deletion strain. Addition of Fe showed no effect on DHAD specific activity in the wild-type cells. To achieve an over expression of the DHAD protein, strains were grown in SD medium lacking leucine (Example 1). Under these conditions, an increase in DHAD specific activity was detected.

TABLE 13

Expression of DHAD from *S. mutans* in the BY4741(Δccc1) strain.

| Strains | Growth conditions | No extra Fe | 100 uM Fe |
|---|---|---|---|
| Wild-type | -Ura | 0.37 ± 0.03 | 0.46 ± 0.04 |
| Δccc1 | -Ura | 0.83 ± 0.04 | 1.24 ± 0.03 |
| Wild-type | -Leu | 1.60 ± 0.17 | 1.83 ± 0.31 |
| Δccc1 | -Leu | 2.53 ± 0.29 | 2.7 ± 1.07 |

Example 6

Improvement of Specific Activity of DHAD from *L. lactis* Expressed in Yeast

Figure 11:
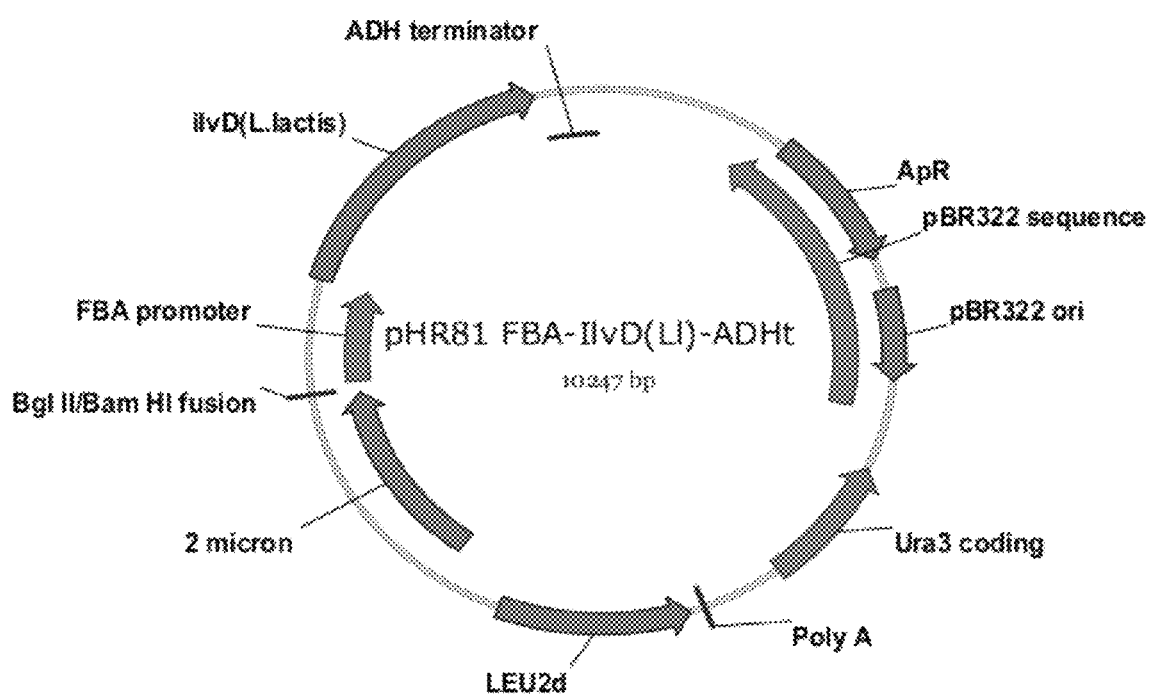
FIG. 11 depicts a vector map of a vector for overexpression of the IlvD gene from L. lactis.

Examples 1-5 used the DHAD enzyme from *S. mutans* to identify novel ways to increase the specific activity of DHAD when expressed in yeast. In this example, we investigated the application of these methods to improve the specific activity of the DHAD enzyme from *L. lactis* (SEQ ID NO: 958). The IlvD gene from *L. lactis* (SEQ ID NO: 959) was cloned into the pHR81 vector under the control of the FBA promoter (FIG. 11). The resulting construct pHR81 FBA-IlvD(L1)-ADHt (FIG. 11; SEQ ID NO: 960) was transformed into strains with a deletion in either the FRA2 or GRX3 gene. To study the effect of the constitutive mutant Aft1p(L99A) on DHAD from *L. lactis*, pHR81 FBA-IlvD(L1)-ADHt was co-transformed into yeast host along with vector pRS411-Aft1 (L99A) (see Example 4). To over-express the IlvD gene, transformants were grown in yeast synthetic drop-out medium lacking leucine or lacking both leucine and methionine, depending on the strains. Enzymatic assay results are summarized in Table 14. Deletions in FRA2 and GRX3 genes increased the specific activity of the DHAD from *L. lactis* when expressed in yeast. In addition, expression of the Aft1 constitutive mutant L99A similarly increased the specific activity of the DHAD from *L. lactis*.

TABLE 14

Over-expression of bacterial DHAD from *L. lactis* in *S. cerevisiae*.

| Strains | Specific Activity (U/mg) |
|---|---|
| Wild-type | 0.23 ± 0.04 |
| Δaft1 + Aft1(L99A) | 0.95 ± 0.31 |
| Δfra2 | 0.72 ± 0.04 |
| Δgrx3 | 0.96 ± 0.05 |

Example 7

Determining the Specific Activity of DHAD. (Assay Method)

Quantitation of the activity of proteins requiring Fe—S clusters can be done in an assay format. If the protein is an enzyme, such as DHAD, the activity is typically expressed in terms of units of activity. A unit of enzyme activity has been defined by the Enzyme Commission of the International Union of Biochemistry as the amount of enzyme that will catalyze the transformation of 1 micromole of the substrate per minute under standard conditions (International Union of Biochemistry, Report of the Commission on Enzymes, Oxford: Pergamon Press, 1961). Further, the term specific activity is defined as the units of activity in a given amount of enzyme. Thus, the specific activity is not directly measured but is calculated by dividing 1) the activity in units/ml of the enzyme sample by 2) the concentration of protein in that sample, so the specific activity is expressed as units/mg. The specific activity of a sample of pure, fully active enzyme is a characteristic of that enzyme. The specific activity of a sample of a mixture of proteins is a measure of the relative fraction of protein in that sample that is composed of the active enzyme of interest. DHAD activity can be measured spectrophotometrically in an end point assay using the 2,4-dinitrophenylhydrazine (2,4-DNPH) method as described in Flint, D. H. and M. H. Emptage, *J. Biol. Chem.* 263:3558-64 (1988). In this assay, the 2,4-DNPH reacts with the keto group of the 2-ketoisovaleric acid product to form a hydrazone, which is detected by its absorbance at 550 nm. The assay buffer contains 50 mM Tris-HCl, 10 mM $MgCl_2$, pH 8.0 (TM8 buffer). Sufficient 2,3-dihydroxyisovaleric acid is added to the assay buffer so that its final concentration in the assay mix is 10 mM. In each assay, an enzyme containing solution and sufficient substrate containing buffer are mixed so that the final volume is 1 ml. The assay mixture is normally incubated at 37° C. for 30 minutes.

The assay is stopped by adding 250 µl of 10% (W/V) trichloroacetic acid. A few minutes later, 500 µl of a saturated solution of 2,4-DNPH in 1 N HCl is added. The mixture is incubated at room temperature for at least 10 min to allow formation of the hydrazone. Next, 1.75 ml of NaOH is added to solubilize the hydrazone and to precipitate unreacted 2,4-DNPH. A few minutes after the NaOH is added, the assay tubes are placed in a sonicator bath for 10 min to degas. The tubes are then centrifuged in a desk top centrifuge at top speed for 2 min to sediment the precipitate.

The absorbance of the supernatant is then read at 550 nm within 1 hour. The absorbance of the sample assays minus the control assays are divided by 2600 (determined from an α-ketoisovaleric acid standard curve) to find the units of enzyme activity in the assay. This assay was used in the Examples described herein in which DHAD specific activity was determined.

Example 8

Purification and Characterization of DHAD from *S. mutans* Expressed in *E. coli*

DHAD from *S. mutans* was purified and characterized as follows. Six liters of culture of the *E. coli* Turner strain harboring the pET28a plasmid containing the *S. mutans* ilvD gene were grown and induced with IPTG. The *S. mutans* DHAD was purified by breaking the cells with a sonicator in TM8 buffer (see Example 7), centrifuging the crude extract to remove cell debris, then loading the supernatant of the crude extract on a Q Sepharose (GE Healthcare) column and eluting the DHAD with an increasing concentration of NaCl in TM8 buffer. The fractions containing DHAD were pooled, brought to 1 M $(NH_4)_2SO_4$, and loaded onto a Phenyl-Sepharose column (GE Healthcare) equilibrated with 1 M $(NH_4)_2SO_4$. The DHAD was eluted with a decreasing concentration of $(NH_4)_2SO_4$. The fractions containing DHAD were pooled, concentrated to ≤10 ml, loaded onto a 35×600 cm Superdex-200 column (577 ml bed volume) (GE Healthcare) column, and eluted with TM8 buffer. As judged by SDS gels, the purity of the *S. mutans* DHAD eluted from the Superdex column was estimated to be ≥90%.

Figure 3:
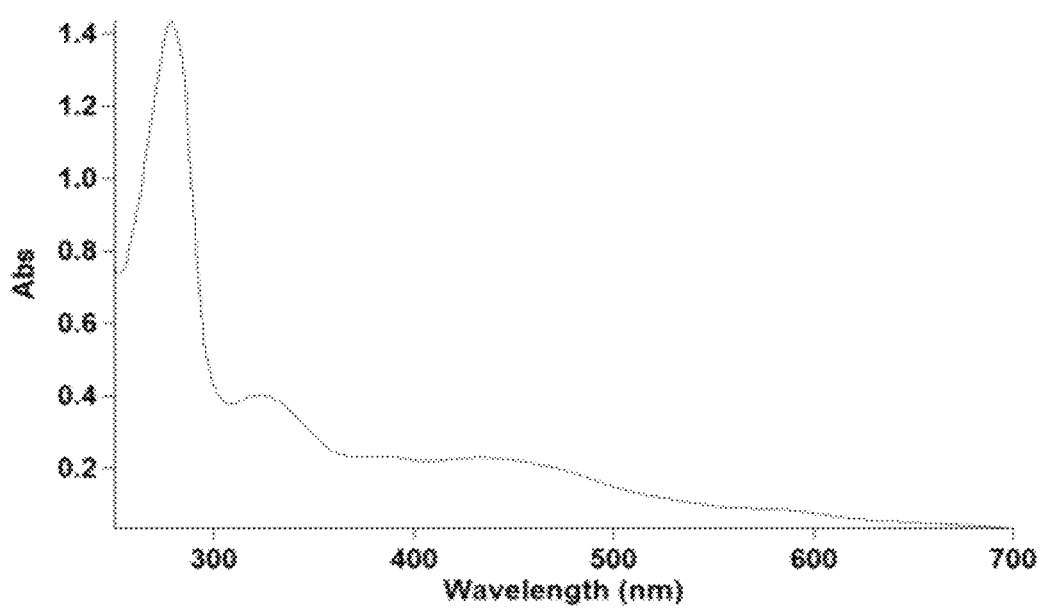
FIG. 3 depicts a UV-Vis absorbance spectrum of purified S. mutans DHAD.
Figure 4:
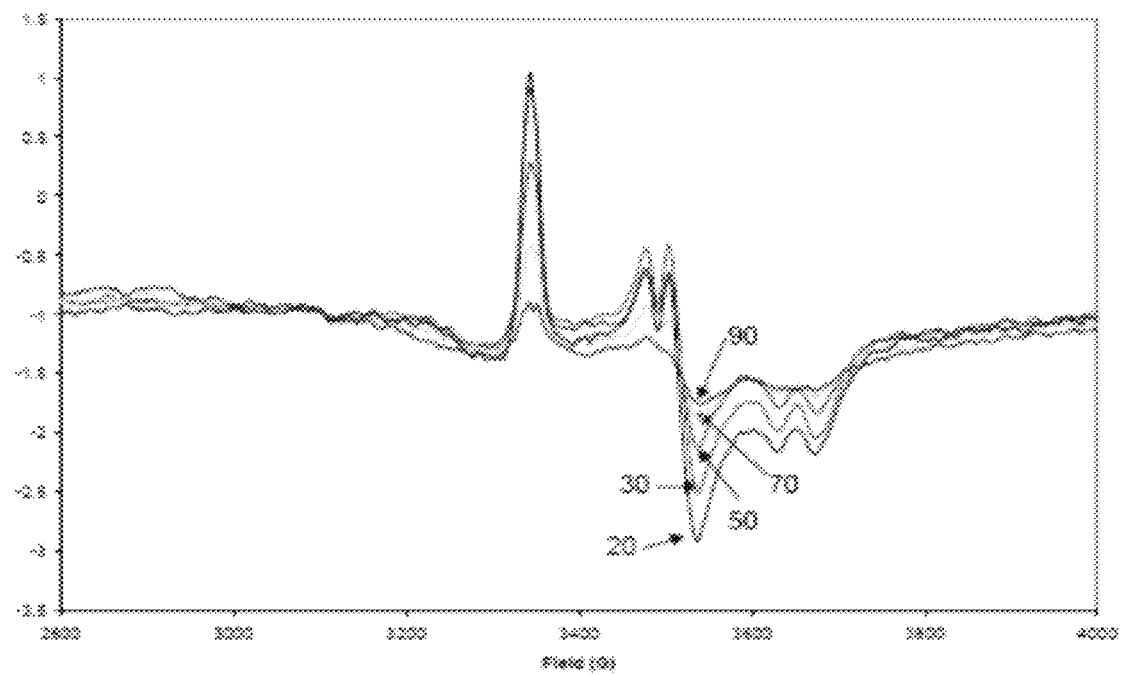
FIG. 4 depicts an EPR spectrum of purified S. mutans DHAD.

The UV-visible spectrum of the purified *S. mutans* DHAD is shown in FIG. 3. The number of peaks above 300 nm is typical of proteins with [2Fe-2S] clusters. The *S. mutans* DHAD was reduced with sodium dithionite, and its EPR spectra was measured at various temperatures. FIG. 4 shows the EPR spectra measured at temperatures between 20° K and 70° K. The EPR spectrum of the *S. mutans* DHAD is measureable up to 70° K, which indicates that it contains a [2Fe-2S] cluster and not a [4Fe-4S] cluster because the EPR spectra of proteins containing [4Fe-4S] clusters are not observable at temperatures much above 10° K.

The exact protein content of the batch of purified *S. mutans* DHAD with the highest specific activity using the Bradford protein assay was determined by quantitative amino acid analysis. Combining the activity with the protein content gave a specific activity of 100 units/mg for this batch. The iron content of this batch determined by ICP-MS using methodology known in the art was 2 molecules of iron per molecule of DHAD. This is consistent with this batch of *S. mutans* DHAD containing a full complement of [2Fe-2S] clusters.

Example 9

Separating the Forms of DHAD in Yeast Crude Extract from Other Proteins in the Cell and from Each Other to Measure the Amount of DHAD Present DHAD protein in yeast cells exists in the forms of dimers with two Fe—S clusters/dimer, one Fe—S cluster/dimer, and zero Fe—S clusters/dimer. A method to measure the concentration of these three forms of DHAD protein in yeast crude extracts was developed using a Mono Q column and a Source 15 PHE PE 4.6/100 column (both columns obtained from GE Healthcare), and is described below.

Frozen yeast cells were thawed, suspended in 50 mM Tris-HCl, 10 mM $MgCl_2$, pH 8.0 (TM8), then broken by bead beating. The broken cells are centrifuged to remove the cell debris and generate the yeast crude extract.

The crude extract was loaded onto a 4 ml Mono Q column attached to an AKTA chromatographic system (GE Healthcare) with the A buffer being TM8 and B buffer being TM8 containing 0.5 M NaCl. The column was equilibrated with A buffer before the sample was loaded. The *S. mutans* DHAD bound to the Mono Q column under these conditions. After the sample was loaded onto the column, the column was washed with 10 mL of TM8 buffer, then the concentration of NaCl in the eluant was increased to 0.22 M NaCl. This was followed by a 30 mL linear gradient from 0.22 M to 0.35 M NaCl. During chromatography, the $A_{215}$ of the column eluate was monitored, and 1 mL fractions were collected. The fractions were assayed for DHAD activity. The sum of the activity of the DHAD in the fractions off the Mono Q column was close to that in the crude extract. Good separations using this column were obtained with as much as 5 mL of crude extract representing up to 1 g of yeast cell paste. The DHAD containing fractions were pooled and made 1.35 M in $(NH_4)_2SO_4$ in preparation for chromatography on the PHE column.

The Source 15 PHE PE 4.6/100 column was also attached to an AKTA chromatographic system with the A buffer being TM8 containing 1.5 M $(NH_4)_2SO_4$ and the B buffer being TM8. Before each run the column was equilibrated with 90% A. The pooled fractions from the Mono Q column made 1.35 M in $(NH_4)_2SO_4$ were loaded onto the PHE column, and at this $(NH_4)_2SO_4$ concentration, the DHAD bound to the column. During chromatography, the $A_{215}$ of the column eluate was monitored, and 1 mL fractions were collected. The DHAD eluted from the column in three peaks when the column was developed with a 30 mL decreasing linear gradient of $(NH_4)_2SO_4$ from 1.35 M to 0 M. The area of each of the DHAD peaks was determined by integration. This elution scheme was found to be ideal for separating S. mutans DHAD from other yeast proteins that co-eluted with it off the Mono Q column. SDS gels run on fractions where the peaks eluted showed that well over 90% of the protein present in these peaks was DHAD when it was expressed at 1% of the soluble protein in yeast cells. The fractions containing each of the three DHAD peaks were pooled separately. Based on the UV-visible absorbent spectrum and the iron and sulfide contents of the DHAD in these peaks, it was determined that the first peak contained DHAD with two [2Fe-2S] clusters/dimers, the second peak contained DHAD with one [2Fe-2S] cluster/dimer, and the third peak contained DHAD with zero [2Fe-2S] clusters/dimers. Thus, in its native state, the S. mutans DHAD enzyme appears to exist as a dimer of two monomeric DHAD proteins.

A standard curve relating the amount of DHAD present in a sample to the sum of the area of the three DHAD peaks off the PHE column was obtained as follows. Crude extract from yeast cells containing no S. mutans DHAD was spiked with various amounts of purified S. mutans DHAD. These extracts were subjected to chromatography on the Mono Q and PHE columns as described above. The area under each of the three DHAD peaks was integrated. The sum of these areas was plotted against the amount of pure DHAD spiked into the yeast crude extracts. The plot was used to derive the following equation:

μg DHAD in sample of crude extract=0.507×
(summed area counts of the three DHAD peaks)

The DHAD activity in a crude extract of yeast can be readily determined by the method described in Example 7. The amount of DHAD protein in yeast crude extracts can be determined by the procedure outlined in this Example. With this data, one can calculate the specific activity of the S. mutans DHAD protein per se in crude extracts according to the procedure in Example 10.

Example 10

Methods to Determine the Fraction of DHAD in Yeast Crude Extract Loaded with Fe—S Clusters When a purified Fe—S cluster requiring protein contains a full complement of clusters, it will have a characteristic specific activity. As previously mentioned, for S. mutans DHAD this specific activity is 100 units/mg when it has a full complement of clusters.

A DHAD sample that has on average one Fe—S cluster/per dimer could contain some dimers with two clusters, some dimers with one cluster, and some dimers with no clusters. Alternatively, if cluster addition to a dimer is all or none and on average there is one Fe—S cluster/dimer in a sample, half of the DHAD dimers would have a full complement of clusters and half would be without clusters. From the results in Example 9, we know that all or none behavior is not followed by S. mutans DHAD because a species with one cluster per dimer can be isolated. We have found that dimers of S. mutans DHAD that have one Fe—S cluster have ½ the activity of dimers with two Fe—S clusters/dimer, i.e., the specific activity of S. mutans DHAD with ½ of a full complement of Fe—S clusters is 50 units/mg. This means the absence of an Fe—S cluster in one of the monomers of a dimer does not influence the activity of the other monomer should it contain an Fe—S cluster.

With the information obtained with the procedures described in Example 9 and the information described so far in this Example, one can determine the degree of Fe—S cluster loading in a DHAD sample in two different ways.

First, one can compare the ratio of the amounts of the three DHAD peaks to determine the relative amount that has two clusters per dimer, one cluster per dimer, and zero clusters per dimer. This gives the degree of cluster loading. For example, if the area of peak 1 off the PHE column was 25%, peak 2 was 50%, and peak 3 was 25% of the sum of the areas of peak 1, peak 2, and peak 3, the percent of the monomers loaded with clusters can be calculated to be 50% according to the following equation:

100*[2*(area of peak 1)+1*(area of peak 2)+0*(area of peak 3)]/[2*(total peak area)]=% DHAD monomers with Fe—S clusters.

Second, one can use the specific activity of the DHAD present to calculate the degree of cluster loading. One determines the specific activity by dividing the activity determined as described in Example 7 with the amount of DHAD protein determined as described in Example 9. The specific activity is then divided by 100 U/mg to determine the fraction of monomers loaded with clusters. This fraction is multiplied by 100 to determine the percent DHAD monomers with Fe—S clusters.

For example if the specific activity is found to be 50 U/mg, the fraction loaded with clusters is 0.5 and the percent DHAD monomers with Fe—S clusters is 50%.

To make such a calculation, the specific activity must be based on the concentration of the DHAD protein in the crude extract (not the total protein). Determining the concentration of S. mutans DHAD in the presence of other proteins can be accomplished using methods described in Example 9.

Example 11

Specific Activities and Inferred Fraction of the DHAD-loaded Proteins

To determine the fraction of DHAD monomers loaded with Fe—S clusters in several yeast strains grown under different conditions, the methods described above were used. Results are shown in Table 15.

TABLE 15

Specific Activities and Inferred Fraction of the DHAD Loaded Proteins.

| BY Yeast Strain | Growth Conditions | DHAD SA in Crude Extracts (U/mg) | % DHAD is of Crude Extract Protein | % Cluster Occupancy of DHAD |
|---|---|---|---|---|
| WT | -Ura | 0.46 | 2.3 | 10 |
| ΔFRA2 | -Ura | 0.8 | 2.5 | 14 |
| ΔGRX3 | -Ura | 0.99 | 2.4 | 23 |

TABLE 15-continued

Specific Activities and Inferred Fraction of the DHAD Loaded Proteins.

| BY Yeast Strain | Growth Conditions | DHAD SA in Crude Extracts (U/mg) | % DHAD is of Crude Extract Protein | % Cluster Occupancy of DHAD |
|---|---|---|---|---|
| WT | -Leu | 0.82 | 11 | 7 |
| ΔFRA2 | -Leu | 2.2 | 11 | 19 |
| ΔGRX3 | -Leu | 3.5 | 9.5 | 31 |

These results indicate that under these growth conditions, the level of Fe—S cluster loading in the DHAD in strains lacking FRA2 and GRX3 is higher than in strains containing functional copies of these genes. Thus, a higher fraction of the DHAD protein is in the active form in the deletion strains because the content of Fe—S clusters (which are required for activity) is higher.

Example 12

Construction of *Saccharomyces cerevisiae* Strains PNY1505, PNY1541, and PNY1542

The purpose of this Example was to construct *Saccharomyces cerevisiae* strains PNY1505, PNY1541, and PNY1542. These strains were derived from PNY1503 (BP1064). PNY1503 was derived from CEN.PK 113-7D (CBS 8340; Centraalbureau voor Schimmelcultures (CBS) Fungal Biodiversiry Centre, Netherlands). The construction of PNY1503 (BP1064) is described in U.S. Appl. No. 61/368,436, incorporated by reference herein, and in Example 13 below. PNY1505 contains a deletion of the FRA2 gene. PNY1541 and PNY1542 contain an integration of the AFT1 gene with the L99A mutation (AFT1-L99A) at the YPRCΔ15 locus.

Deletions/integrations were created by homologous recombination with PCR fragments containing regions of homology upstream and downstream of the target gene and the URA3 gene for selection of transformants. The URA3 gene was removed by homologous recombination to create a scarless deletion/integration.

The scarless deletion/integration procedure was adapted from Akada et al., *Yeast*, 23(5):399-405 (2006). The PCR cassette for each deletion/integration was made by combining four fragments, A-B-U-C, either by overlapping PCR or by cloning the individual fragments, and gene to be integrated, into a plasmid prior to amplifying the entire cassette by PCR for the deletion/integration procedure. The PCR cassette contained a selectable/counter-selectable marker, URA3 (Fragment U), consisting of the native CEN.PK 113-7D URA3 gene, along with the promoter (250 bp upstream of the URA3 gene) and terminator (150 bp downstream of the URA3 gene) regions. Fragments A (150 bp to 500 bp long) and C (250 bp long) corresponded to the sequence immediately upstream of the target gene (Fragment A) and the 3' sequence of the target gene (Fragment C). Fragments A and C were used for integration of the cassette into the chromosome by homologous recombination. Fragment B (500 bp long) corresponded to the 500 bp immediately downstream of the target gene and was used for excision of the URA3 marker and Fragment C from the chromosome by homologous recombination, as a direct repeat of the sequence corresponding to Fragment B was created upon integration of the cassette into the chromosome.

Using the PCR product ABUC cassette, the URA3 marker was first integrated into and then excised from the chromosome by homologous recombination. The initial integration deleted the gene, excluding the 3' sequence. Upon excision, the 3' region of the gene was also deleted. For integration of genes using this method, the gene to be integrated was included in the cassette between fragments A and B.

FRA2 Deletion

The FRA2 deletion (also described in U.S. Appl. No. 61/380,563, incorporated by reference herein) was designed to delete 250 nucleotides from the 3' end of the coding sequence, leaving the first 113 nucleotides of the FRA2 coding sequence intact. An in-frame stop codon was present 7 nucleotides downstream of the deletion. The four fragments for the PCR cassette for the scarless FRA2 deletion were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). FRA2 Fragment A was amplified with primer oBP594 (SEQ ID NO: 961) and primer oBP595 (SEQ ID NO: 962), containing a 5' tail with homology to the 5' end of FRA2 Fragment B. FRA2 Fragment B was amplified with primer oBP596 (SEQ ID NO: 963), containing a 5' tail with homology to the 3' end of FRA2 Fragment A, and primer oBP597 (SEQ ID NO: 964), containing a 5' tail with homology to the 5' end of FRA2 Fragment U. FRA2 Fragment U was amplified with primer oBP598 (SEQ ID NO: 965), containing a 5' tail with homology to the 3' end of FRA2 Fragment B, and primer oBP599 (SEQ ID NO: 966), containing a 5' tail with homology to the 5' end of FRA2 Fragment C. FRA2 Fragment C was amplified with primer oBP600 (SEQ ID NO: 967), containing a 5' tail with homology to the 3' end of FRA2 Fragment U, and primer oBP601 (SEQ ID NO: 968). PCR products were purified with a PCR Purification kit (Qiagen). FRA2 Fragment AB was created by overlapping PCR by mixing FRA2 Fragment A and FRA2 Fragment B and amplifying with primers oBP594 (SEQ ID NO: 961) and oBP597 (SEQ ID NO: 964). FRA2 Fragment UC was created by overlapping PCR by mixing FRA2 Fragment U and FRA2 Fragment C and amplifying with primers oBP598 (SEQ ID NO: 965) and oBP601 (SEQ ID NO: 968). The resulting PCR products were purified on an agarose gel followed by a Gel Extraction kit (Qiagen). The FRA2 ABUC cassette was created by overlapping PCR by mixing FRA2 Fragment AB and FRA2 Fragment UC and amplifying with primers oBP594 (SEQ ID NO: 961) and oBP601 (SEQ ID NO: 968). The PCR product was purified with a PCR Purification kit (Qiagen).

Competent cells of PNY1503 were made and transformed with the FRA2 ABUC PCR cassette using a Frozen-EZ Yeast Transformation II kit (Zymo Research; Orange, Calif.). Transformation mixtures were plated on synthetic complete media lacking uracil supplemented with 1% ethanol at 30° C. Transformants with a fra2 knockout were screened for by PCR with primers oBP602 (SEQ ID NO: 969) and oBP603 (SEQ ID NO: 970) using genomic DNA prepared with a Gentra Puregene Yeast/Bact kit (Qiagen). A correct transformant was grown in YPE (yeast extract, peptone, 1% ethanol) and plated on synthetic complete medium supplemented with 1% ethanol and containing 5-fluoro-orotic acid (0.1%) at 30° C. to select for isolates that lost the URA3 marker. The deletion and marker removal were confirmed by PCR with primers oBP602 (SEQ ID NO: 969) and oBP603 (SEQ ID NO: 970) using genomic DNA prepared with a Gentra Puregene Yeast/Bact kit (Qiagen). The absence of the FRA2 gene from the isolate was demonstrated by a negative PCR result using primers specific for the deleted coding sequence of FRA2, oBP605 (SEQ ID NO: 971) and oBP606 (SEQ ID NO: 972). The correct isolate was selected as strain CEN.PK 113-7D MATa ura3Δ::loxP his3Δ pdc6Δ pdc1Δ::P[PDC1]-DHAD|ilvD_Sm-PDC1t pdc5Δ::P[PDC5]-ADH|sadB_Ax-PDC5t gpd2Δ::loxP fra2Δ and designated as PNY1505 (BP1135).

ID NO: 974), containing a 5' tail with homology to the 5' end of YPRCΔ15 Fragment B. YPRCΔ15 Fragment B was amplified from genomic DNA with primer oBP624 (SEQ ID NO: 975), containing a 5' tail with homology to the 3' end of

TABLE 16

Primers used in the FRA2 Deletion

| Primer Name | SEQ ID NO | Primer Sequence |
|---|---|---|
| oBP594 | 961 | agctgtctcgtgttgtgggttt |
| oBP595 | 962 | cttaataatagaacaatatcatcctttacgggcatcttatagtgtcgtt |
| oBP596 | 963 | gcgccaacgacactataagatgcccgtaaaggatgatattgttctatta |
| oBP597 | 964 | tatggaccctgaaaccacagccacattgcaacgacgacaatgccaaacc |
| oBP598 | 965 | tccttggtttggcattgtcgtcgttgcaatgtggctgtggtttcagggt |
| oBP599 | 966 | atcctctcgcggagtccctgttcagtaaaggccatgaagcttttctttt |
| oBP600 | 967 | attggaaagaaaaagcttcatggcctttactgaacagggactccgcgag |
| oBP601 | 968 | tcataccacaatcttagaccat |
| oBP602 | 969 | tgttcaaacccctaaccaacc |
| oBP603 | 970 | tgttcccacaatctattaccta |
| oBP605 | 971 | tactgaacagggactccgcga |
| oBP606 | 972 | tcataccacaatcttagacca |

YPRCΔ15 Deletion and AFT1-L99A Integration

The YPRCΔ15 locus was deleted and replaced with AFT1-L99A along with the native promoter region (800 bp) and terminator region (800 bp) from AFT1. The scarless cassette for the YPRCΔ15 deletion-AFT1L99A integration was first cloned into plasmid pUC19-URA3MCS (described in U.S. Appl. No. 61/356,379, incorporated by reference herein). The vector is pUC19 based and contains the sequence of the URA3 gene from S. cerevisiae CEN.PK 113-7D situated within a multiple cloning site (MCS). pUC19 (American Type Culture Collection, Manassas, Va.; ATCC#37254) contains the pMB1 replicon and a gene coding for beta-lactamase for replication and selection in Escherichia coli. In addition to the coding sequence for URA3, the sequences from upstream (250 bp) and downstream (150 bp) of this gene are present for expression of the URA3 gene in yeast. The vector can be used for cloning purposes and can be used as a yeast integration vector.

The DNA encompassing the URA3 coding region along with 250 bp upstream and 150 bp downstream of the URA3 coding region from Saccaromyces cerevisiae CEN.PK 113-7D (CBS 8340; Centraalbureau voor Schimmelcultures (CBS) Fungal Biodiversity Centre, Netherlands) genomic DNA was amplified with primers oBP438 (SEQ ID NO: 1033), containing BamHI, AscI, PmeI, and FseI restriction sites, and oBP439 (SEQ ID NO: 1034), containing XbaI, PacI, and NotI restriction sites. Genomic DNA was prepared using a Gentra Puregene Yeast/Bact kit (Qiagen). The PCR product and pUC19 were ligated with T4 DNA ligase after digestion with BamHI and XbaI to create vector pUC19-URA3MCS. The vector was confirmed by PCR and sequencing with primers oBP264 (SEQ ID NO:1031) and oBP265 (SEQ ID NO: 1032).

YPRCΔ15 Fragment A was amplified from genomic DNA, prepared as above, with primer oBP622 (SEQ ID NO: 973), containing a KpnI restriction site, and primer oBP623 (SEQ YPRCΔ15 Fragment A, and primer oBP625 (SEQ ID NO: 976), containing a FseI restriction site. PCR products were purified with a PCR Purification kit (Qiagen). YPRCΔ15 Fragment A-YPRCΔ15 Fragment B was created by overlapping PCR by mixing the YPRCΔ15 Fragment A and YPRCΔ15 Fragment B PCR products and amplifying with primers oBP622 (SEQ ID NO: 973) and oBP625 (SEQ ID NO: 976). The resulting PCR product was digested with KpnI and FseI and ligated with T4 DNA ligase into the corresponding sites of pUC19-URA3MCS after digestion with the appropriate enzymes. YPRCΔ15 Fragment C was amplified from genomic DNA with primer oBP626 (SEQ ID NO: 977), containing a NotI restriction site, and primer oBP627 (SEQ ID NO: 978), containing a PacI restriction site. The YPRCΔ15 Fragment C PCR product was digested with NotI and PacI and ligated with T4 DNA ligase into the corresponding sites of the plasmid containing YPRCΔ15 Fragments AB. AFT1-L99A, along with the native promoter region (800 bp) and terminator region (800 bp) from AFT1, was amplified using pRS411-AFT1(L99A) (described in Example 4 above) as template with primer oBP744 (SEQ ID NO: 979), containing an AscI restriction site, and primer oBP745 (SEQ ID NO: 980), containing a PmeI restriction site. The PCR product was digested with AscI and PmeI and ligated with T4 DNA ligase into the corresponding sites of the plasmid containing YPRCΔ15 Fragments ABC. The entire integration cassette was amplified from the resulting plasmid with primers oBP622 (SEQ ID NO: 973) and oBP627 (SEQ ID NO: 978).

Competent cells of PNY1503 were made and transformed with the YPRCΔ15 deletion/AFT1-L99A integration cassette PCR product using a Frozen-EZ Yeast Transformation II kit (Zymo Research). Transformation mixtures were plated on synthetic complete media lacking uracil supplemented with 1% ethanol at 30° C. Transformants were grown in YPE (1% ethanol) and plated on synthetic complete medium supplemented with 1% EtOH and containing 5-fluoro-orotic acid (0.1%) at 30° C. to select for isolates that lost the URA3 marker. The deletion of YPRCΔ15 and integration of AFT1L99A were confirmed by PCR with external primers oBP636 (SEQ ID NO: 981) and oBP637 (SEQ ID NO: 982) and with AFT1-L99A specific primer HY840 (SEQ ID NO: 983) and external primer oBP637 (SEQ ID NO: 982) using genomic DNA prepared with a Gentra Puregene Yeast/Bact kit (Qiagen) and by colony PCR. Correct independent isolates of CEN.PK 113-7D MATa ura3Δ::loxP his3Δ pdc6Δ pdc1Δ:: P[PDC1]-DHAD|ilvD_Sm-PDC1t pdc5Δ::P[PDC5]-ADH|sadB_Ax-PDC5t gpd2Δ::loxP yprcΔ15Δ::AFT1L99A were designated as strains PNY1541 and PNY1542.

the 3' 500 bp of the target gene (Fragment C). Fragments A and C were used for integration of the cassette into the chromosome by homologous recombination. Fragment B (500 bp long) corresponded to the 500 bp immediately downstream of the target gene and was used for excision of the URA3 marker and Fragment C from the chromosome by homologous recombination, as a direct repeat of the sequence corresponding to Fragment B was created upon integration of the cassette into the chromosome. Using the PCR product ABUC cassette, the URA3 marker was first integrated into and then excised from the chromosome by homologous recombination. The initial integration deleted the gene, excluding the 3'

TABLE 17

Primers used in the YPRCΔ15 Deletion and AFTI-L99A Integration

| Primer Name | SEQ ID NO | Primer Sequence |
|---|---|---|
| oBP622 | 973 | aattggtaccccaaaaggaatattgggtcaga |
| oBP623 | 974 | ccattgtttaaacggcgcgccggatcctttgcgaaaccctatgctctgt |
| oBP624 | 975 | gcaaaggatccggcgcgccgtttaaacaatggaaggtcgggatgagcat |
| oBP625 | 976 | aattggccggctacgtaacattctgtcaaccaa |
| oBP626 | 977 | aattgcggccgcttcatatatgacgtaataaaat |
| oBP627 | 978 | aattttaattaattttttttcttggaatcagtac |
| oBP744 | 979 | aattggcgcgccagagtacaacgatcaccgcctg |
| oBP745 | 980 | aattgtttaaacgaacgaaagttacaaaatctag |
| oBP636 | 981 | cattttttccctctaagaagc |
| oBP637 | 982 | tttttgcacagttaaactaccc |
| HY840 | 983 | CCAAAATCAGCCCCACGACGGCCATA |

Example 13

Construction of *Saccharomyces cerevisiae* Strain BP1064 (PNY1503)

The strain BP1064 was derived from CEN.PK 113-7D (CBS 8340; Centraalbureau voor Schimmelcultures (CBS) Fungal Biodiversity Centre, Netherlands) and contains deletions of the following genes: URA3, HIS3, PDC1, PDC5, PDC6, and GPD2.

Deletions, which completely removed the entire coding sequence, were created by homologous recombination with PCR fragments containing regions of homology upstream and downstream of the target gene and either a G418 resistance marker or URA3 gene for selection of transformants. The G418 resistance marker, flanked by loxP sites, was removed using Cre recombinase. The URA3 gene was removed by homologous recombination to create a scarless deletion, or if flanked by loxP sites was removed using Cre recombinase.

The scarless deletion procedure was adapted from Akada et al. 2006 *Yeast* v 23 p 399. In general, the PCR cassette for each scarless deletion was made by combining four fragments, A-B-U-C, by overlapping PCR. The PCR cassette contained a selectable/counter-selectable marker, URA3 (Fragment U), consisting of the native CEN.PK 113-7D URA3 gene, along with the promoter (250 bp upstream of the URA3 gene) and terminator (150 bp downstream of the URA3 gene). Fragments A and C, each 500 bp long, corresponded to the 500 bp immediately upstream of the target gene (Fragment A) and 500 bp. Upon excision, the 3' 500 bp region of the gene was also deleted. For integration of genes using this method, the gene to be integrated was included in the PCR cassette between fragments A and B.

URA3 Deletion

To delete the endogenous URA3 coding region, a ura3::loxP-kanMX-loxP cassette was PCR-amplified from pLA54 template DNA (SEQ ID NO: 986). pLA54 contains the *K. lactis* TEF1 promoter and kanMX marker, and is flanked by loxP sites to allow recombination with Cre recombinase and removal of the marker. PCR was done using Phusion DNA polymerase and primers BK505 and BK506 (SEQ ID NOs: 987 and 988, respectively). The URA3 portion of each primer was derived from the 5' region upstream of the URA3 promoter and 3' region downstream of the coding region such that integration of the loxP-kanMX-loxP marker resulted in replacement of the URA3 coding region. The PCR product was transformed into CEN.PK 113-7D using standard genetic techniques (*Methods in Yeast Genetics*, 2005, Cold Spring Harbor Laboratory Press, Cold Spring Harbor, N.Y., pp. 201-202) and transformants were selected on YPD containing G418 (100 µg/ml) at 30 C. Transformants were screened to verify correct integration by PCR using primers LA468 and LA492 (SEQ ID NOs: 989 and 990, respectively) and designated CEN.PK 113-7D Δura3::kanMX.

HIS3 Deletion

The four fragments for the PCR cassette for the scarless HIS3 deletion were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). HIS3 Fragment A was amplified with primer oBP452 (SEQ ID NO: 991) and primer oBP453 (SEQ ID NO: 992), containing a 5' tail with homology to the 5' end of HIS3 Fragment B. HIS3 Fragment B was amplified with primer oBP454 (SEQ ID NO: 993), containing a 5' tail with homology to the 3' end of HIS3 Fragment A, and primer oBP455 (SEQ ID NO: 994), containing a 5' tail with homology to the 5' end of HIS3 Fragment U. HIS3 Fragment U was amplified with primer oBP456 (SEQ ID NO: 995), containing a 5' tail with homology to the 3' end of HIS3 Fragment B, and primer oBP457 (SEQ ID NO: 996), containing a 5' tail with homology to the 5' end of HIS3 Fragment C. HIS3 Fragment C was amplified with primer oBP458 (SEQ ID NO: 997), containing a 5' tail with homology to the 3' end of HIS3 Fragment U, and primer oBP459 (SEQ ID NO: 998). PCR products were purified with a PCR Purification kit (Qiagen). HIS3 Fragment AB was created by overlapping PCR by mixing HIS3 Fragment A and HIS3 Fragment B and amplifying with primers oBP452 (SEQ ID NO: 991) and oBP455 (SEQ ID NO: 994). HIS3 Fragment UC was created by overlapping PCR by mixing HIS3 Fragment U and HIS3 Fragment C and amplifying with primers oBP456 (SEQ ID NO: 995) and oBP459 (SEQ ID NO: 998). The resulting PCR products were purified on an agarose gel followed by a Gel Extraction kit (Qiagen). The HIS3 ABUC cassette was created by overlapping PCR by mixing HIS3 Fragment AB and HIS3 Fragment UC and amplifying with primers oBP452 (SEQ ID NO: 991) and oBP459 (SEQ ID NO: 998). The PCR product was purified with a PCR Purification kit (Qiagen).

Competent cells of CEN.PK 113-7D Δura3::kanMX were made and transformed with the HIS3 ABUC PCR cassette using a Frozen-EZ Yeast Transformation II kit (Zymo Research; Orange, Calif.). Transformation mixtures were plated on synthetic complete media lacking uracil supplemented with 2% glucose at 30° C. Transformants with a his3 knockout were screened for by PCR with primers oBP460 (SEQ ID NO: 999) and oBP461 (SEQ ID NO: 1000) using genomic DNA prepared with a Gentra Puregene Yeast/Bact kit (Qiagen). A correct transformant was selected as strain CEN.PK 113-7D Δura3::kanMX Δhis3::URA3.

KanMX Marker Removal from the Δura3 Site and URA3 Marker Removal from the Δhis3 Site The KanMX marker was removed by transforming CEN.PK 113-7D Δura3::kanMX Δhis3::URA3 with pRS423::PGAL1-cre (SEQ ID NO: 1011, described in U.S. Provisional Application No. 61/290,639) using a Frozen-EZ Yeast Transformation II kit (Zymo Research) and plating on synthetic complete medium lacking histidine and uracil supplemented with 2% glucose at 30° C. Transformants were grown in YP supplemented with 1% galactose at 30° C. for ~6 hours to induce the Cre recombinase and KanMX marker excision and plated onto YPD (2% glucose) plates at 30° C. for recovery. An isolate was grown overnight in YPD and plated on synthetic complete medium containing 5-fluoro-orotic acid (0.1%) at 30° C. to select for isolates that lost the URA3 marker. 5-FOA resistant isolates were grown in and plated on YPD for removal of the pRS423::$P_{GAL1}$-cre plasmid. Isolates were checked for loss of the KanMX marker, URA3 marker, and pRS423::$P_{GAL1}$-cre plasmid by assaying growth on YPD+G418 plates, synthetic complete medium lacking uracil plates, and synthetic complete medium lacking histidine plates. A correct isolate that was sensitive to G418 and auxotrophic for uracil and histidine was selected as strain CEN.PK 113-7D Δura3::loxP Δhis3 and designated as BP857. The deletions and marker removal were confirmed by PCR and sequencing with primers oBP450 (SEQ ID NO: 1001) and oBP451 (SEQ ID NO: 1002) for Δura3 and primers oBP460 (SEQ ID NO: 999) and oBP461 (SEQ ID NO: 1000) for Δhis3 using genomic DNA prepared with a Gentra Puregene Yeast/Bact kit (Qiagen).

PDC6 Deletion

The four fragments for the PCR cassette for the scarless PDC6 deletion were amplified using Phusion High Fidelity PCR Master Mix (New England BioLabs) and CEN.PK 113-7D genomic DNA as template, prepared with a Gentra Puregene Yeast/Bact kit (Qiagen). PDC6 Fragment A was amplified with primer oBP440 (SEQ ID NO: 1003) and primer oBP441 (SEQ ID NO: 1004), containing a 5' tail with homology to the 5' end of PDC6 Fragment B. PDC6 Fragment B was amplified with primer oBP442 (SEQ ID NO: 1005), containing a 5' tail with homology to the 3' end of PDC6 Fragment A, and primer oBP443 (SEQ ID NO: 1006), containing a 5' tail with homology to the 5' end of PDC6 Fragment U. PDC6 Fragment U was amplified with primer oBP444 (SEQ ID NO: 1007), containing a 5' tail with homology to the 3' end of PDC6 Fragment B, and primer oBP445 (SEQ ID NO: 1008), containing a 5' tail with homology to the 5' end of PDC6 Fragment C. PDC6 Fragment C was amplified with primer oBP446 (SEQ ID NO: 1009), containing a 5' tail with homology to the 3' end of PDC6 Fragment U, and primer oBP447 (SEQ ID NO: 1010). PCR products were purified with a PCR Purification kit (Qiagen). PDC6 Fragment AB was created by overlapping PCR by mixing PDC6 Fragment A and PDC6 Fragment B and amplifying with primers oBP440 (SEQ ID NO: 1003) and oBP443 (SEQ ID NO: 1006). PDC6 Fragment UC was created by overlapping PCR by mixing PDC6 Fragment U and PDC6 Fragment C and amplifying with primers oBP444 (SEQ ID NO: 1007) and oBP447 (SEQ ID NO: 1010). The resulting PCR products were purified on an agarose gel followed by a Gel Extraction kit (Qiagen). The PDC6 ABUC cassette was created by overlapping PCR by mixing PDC6 Fragment AB and PDC6 Fragment UC and amplifying with primers oBP440 (SEQ ID NO: 1003) and oBP447 (SEQ ID NO: 1010). The PCR product was purified with a PCR Purification kit (Qiagen).

Competent cells of CEN.PK 113-7D Δura3::loxP Δhis3 were made and transformed with the PDC6 ABUC PCR cassette using a Frozen-EZ Yeast Transformation II kit (Zymo Research). Transformation mixtures were plated on synthetic complete media lacking uracil supplemented with 2% glucose at 30° C. Transformants with a pdc6 knockout were screened for by PCR with primers oBP448 (SEQ ID NO: 1012) and oBP449 (SEQ ID NO: 1013) using genomic DNA prepared with a Gentra Puregene Yeast/Bact kit (Qiagen). A correct transformant was selected as strain CEN.PK 113-7D Δura3::loxP Δhis3 Δpdc6::URA3.

CEN.PK 113-7D Δura3::loxP Δhis3 Δpdc6::URA3 was grown overnight in YPD and plated on synthetic complete medium containing 5-fluoro-orotic acid (0.1%) at 30° C. to select for isolates that lost the URA3 marker. The deletion and marker removal were confirmed by PCR and sequencing with primers oBP448 (SEQ ID NO: 1012) and oBP449 (SEQ ID NO: 1013) using genomic DNA prepared with a Gentra Puregene Yeast/Bact kit (Qiagen). The absence of the PDC6 gene from the isolate was demonstrated by a negative PCR result using primers specific for the coding sequence of PDC6, oBP554 (SEQ ID NO: 1014) and oBP555 (SEQ ID NO: 1015). The correct isolate was selected as strain CEN.PK 113-7D Δura3::loxP Δhis3 Δpdc6 and designated as BP891.

PDC1 Deletion ilvDSm Integration

The PDC1 gene was deleted and replaced with the ilvD coding region from *Streptococcus mutans* ATCC #700610. The A fragment followed by the ilvD coding region from

*Streptococcus mutans* for the PCR cassette for the PDC1 deletion-ilvDSm integration was amplified using Phusion High Fidelity PCR Master Mix (New England BioLabs) and NYLA83 (described in U.S. Provisional Application No. 61/246,709) genomic DNA as template, prepared with a Gentra Puregene Yeast/Bact kit (Qiagen). PDC1 Fragment A-ilvDSm (SEQ ID NO: 1053) was amplified with primer oBP513 (SEQ ID NO: 1016) and primer oBP515 (SEQ ID NO: 1017), containing a 5' tail with homology to the 5' end of PDC1 Fragment B. The B, U, and C fragments for the PCR cassette for the PDC1 deletion-ilvDSm integration were amplified using Phusion High Fidelity PCR Master Mix (New England BioLabs) and CEN.PK 113-7D genomic DNA as template, prepared with a Gentra Puregene Yeast/Bact kit (Qiagen). PDC1 Fragment B was amplified with primer oBP516 (SEQ ID NO: 1018) containing a 5' tail with homology to the 3' end of PDC1 Fragment A-ilvDSm, and primer oBP517 (SEQ ID NO: 1019), containing a 5' tail with homology to the 5' end of PDC1 Fragment U. PDC1 Fragment U was amplified with primer oBP518 (SEQ ID NO: 1020), containing a 5' tail with homology to the 3' end of PDC1 Fragment B, and primer oBP519 (SEQ ID NO: 1021), containing a 5' tail with homology to the 5' end of PDC1 Fragment C. PDC1 Fragment C was amplified with primer oBP520 (SEQ ID NO: 1022), containing a 5' tail with homology to the 3' end of PDC1 Fragment U, and primer oBP521 (SEQ ID NO: 1023). PCR products were purified with a PCR Purification kit (Qiagen). PDC1 Fragment A-ilvDSm-B was created by overlapping PCR by mixing PDC1 Fragment A-ilvDSm and PDC1 Fragment B and amplifying with primers oBP513 (SEQ ID NO: 1016) and oBP517 (SEQ ID NO: 1019). PDC1 Fragment UC was created by overlapping PCR by mixing PDC1 Fragment U and PDC1 Fragment C and amplifying with primers oBP518 (SEQ ID NO: 1020) and oBP521 (SEQ ID NO: 1023). The resulting PCR products were purified on an agarose gel followed by a Gel Extraction kit (Qiagen). The PDC1 A-ilvDSm-BUC cassette (SEQ ID NO: 1054) was created by overlapping PCR by mixing PDC1 Fragment A-ilvDSm-B and PDC1 Fragment UC and amplifying with primers oBP513 (SEQ ID NO: 1016) and oBP521 (SEQ ID NO: 1023). The PCR product was purified with a PCR Purification kit (Qiagen).

Competent cells of CEN.PK 113-7D Δura3::loxP Δhis3 Δpdc6 were made and transformed with the PDC1 A-ilvDSm-BUC PCR cassette using a Frozen-EZ Yeast Transformation II kit (Zymo Research). Transformation mixtures were plated on synthetic complete media lacking uracil supplemented with 2% glucose at 30° C. Transformants with a pdc1 knockout ilvDSm integration were screened for by PCR with primers oBP511 (SEQ ID NO: 1024) and oBP512 (SEQ ID NO: 1025) using genomic DNA prepared with a Gentra Puregene Yeast/Bact kit (Qiagen). The absence of the PDC1 gene from the isolate was demonstrated by a negative PCR result using primers specific for the coding sequence of PDC1, oBP550 (SEQ ID NO: 1026) and oBP551 (SEQ ID NO: 1027). A correct transformant was selected as strain CEN.PK 113-7D Δura3::loxP Δhis3 Δpdc6 Δpdc1::ilvDSm-URA3.

CEN.PK 113-7D Δura3::loxP Δhis3 Δpdc6 Δpdc1::ilvDSm-URA3 was grown overnight in YPD and plated on synthetic complete medium containing 5-fluoro-orotic acid (0.1%) at 30° C. to select for isolates that lost the URA3 marker. The deletion of PDC1, integration of ilvDSm, and marker removal were confirmed by PCR and sequencing with primers oBP511 (SEQ ID NO: 1024) and oBP512 (SEQ ID NO: 1025) using genomic DNA prepared with a Gentra Puregene Yeast/Bact kit (Qiagen). The correct isolate was selected as strain CEN.PK 113-7D Δura3::loxP Δhis3 Δpdc6 Δpdc1::ilvDSm and designated as BP907.

PDC5 Deletion sadB Integration

The PDC5 gene was deleted and replaced with the sadB coding region from *Achromobacter xylosoxidans*. A segment of the PCR cassette for the PDC5 deletion-sadB integration was first cloned into plasmid pUC19-URA3MCS.

pUC19-URA3MCS is pUC19 based and contains the sequence of the URA3 gene from *Saccaromyces cerevisiae* situated within a multiple cloning site (MCS). pUC19 contains the pMB1 replicon and a gene coding for beta-lactamase for replication and selection in *Escherichia coli*. In addition to the coding sequence for URA3, the sequences from upstream and downstream of this gene were included for expression of the URA3 gene in yeast. The vector can be used for cloning purposes and can be used as a yeast integration vector.

The DNA encompassing the URA3 coding region along with 250 bp upstream and 150 bp downstream of the URA3 coding region from *Saccaromyces cerevisiae* CEN.PK 113-7D genomic DNA was amplified with primers oBP438 (SEQ ID NO: 1033), containing BamHI, AscI, PmeI, and FseI restriction sites, and oBP439 (SEQ ID NO: 1034), containing XbaI, PacI, and NotI restriction sites, using Phusion High-Fidelity PCR Master Mix (New England BioLabs). Genomic DNA was prepared using a Gentra Puregene Yeast/Bact kit (Qiagen). The PCR product and pUC19 (SEQ ID NO: 1056) were ligated with T4 DNA ligase after digestion with BamHI and XbaI to create vector pUC19-URA3MCS. The vector was confirmed by PCR and sequencing with primers oBP264 (SEQ ID NO: 1031) and oBP265 (SEQ ID NO: 1032).

The coding sequence of sadB and PDC5 Fragment B were cloned into pUC19-URA3MCS to create the sadB-BU portion of the PDC5 A-sadB-BUC PCR cassette. The coding sequence of sadB was amplified using pLH468-sadB (SEQ ID NO: 1051) as template with primer oBP530 (SEQ ID NO: 1035), containing an AscI restriction site, and primer oBP531 (SEQ ID NO: 1036), containing a 5' tail with homology to the 5' end of PDC5 Fragment B. PDC5 Fragment B was amplified with primer oBP532 (SEQ ID NO: 1037), containing a 5' tail with homology to the 3' end of sadB, and primer oBP533 (SEQ ID NO: 1038), containing a PmeI restriction site. PCR products were purified with a PCR Purification kit (Qiagen). sadB-PDC5 Fragment B was created by overlapping PCR by mixing the sadB and PDC5 Fragment B PCR products and amplifying with primers oBP530 (SEQ ID NO: 1035) and oBP533 (SEQ ID NO: 1038). The resulting PCR product was digested with AscI and PmeI and ligated with T4 DNA ligase into the corresponding sites of pUC19-URA3MCS after digestion with the appropriate enzymes. The resulting plasmid was used as a template for amplification of sadB-Fragment B-Fragment U using primers oBP536 (SEQ ID NO: 1039) and oBP546 (SEQ ID NO: 1040), containing a 5' tail with homology to the 5' end of PDC5 Fragment C. PDC5 Fragment C was amplified with primer oBP547 (SEQ ID NO: 1041) containing a 5' tail with homology to the 3' end of PDC5 sadB-Fragment B-Fragment U, and primer oBP539 (SEQ ID NO: 1042). PCR products were purified with a PCR Purification kit (Qiagen). PDC5 sadB-Fragment B-Fragment U-Fragment C was created by overlapping PCR by mixing PDC5 sadB-Fragment B-Fragment U and PDC5 Fragment C and amplifying with primers oBP536 (SEQ ID NO: 1039) and oBP539 (SEQ ID NO: 1042). The resulting PCR product was purified on an agarose gel followed by a Gel Extraction kit (Qiagen). The PDC5 A-sadB-BUC cassette (SEQ ID NO: 1055) was created by amplifying PDC5-sadB-Fragment B-Fragment U-Fragment C with primers oBP542 (SEQ ID NO: 1043), containing a 5' tail with homology to the 50 nucleotides immediately upstream of the native PDC5 coding sequence, and oBP539 (SEQ ID NO: 1042). The PCR product was purified with a PCR Purification kit (Qiagen).

Competent cells of CEN.PK 113-7D Δura3::loxP Δhis3 Δpdc6 Δpdc1::ilvDSm were made and transformed with the PDC5 A-sadB-BUC PCR cassette using a Frozen-EZ Yeast Transformation II kit (Zymo Research). Transformation mixtures were plated on synthetic complete media lacking uracil supplemented with 1% ethanol (no glucose) at 30° C. Transformants with a pdc5 knockout sadB integration were screened for by PCR with primers oBP540 (SEQ ID NO: 1044) and oBP541 (SEQ ID NO: 1045) using genomic DNA prepared with a Gentra Puregene Yeast/Bact kit (Qiagen). The absence of the PDC5 gene from the isolate was demonstrated by a negative PCR result using primers specific for the coding sequence of PDC5, oBP552 (SEQ ID NO: 1046) and oBP553 (SEQ ID NO: 1047). A correct transformant was selected as strain CEN.PK 113-7D Δura3::loxP Δhis3 Δpdc6 Δpdc1::ilvDSm Δpdc5::sadB-URA3.

CEN.PK 113-7D Δura3::loxP Δhis3 Δpdc6 Δpdc1::ilvDSm Δpdc5::sadB-URA3 was grown overnight in YPE (1% ethanol) and plated on synthetic complete medium supplemented with ethanol (no glucose) and containing 5-fluoro-orotic acid (0.1%) at 30° C. to select for isolates that lost the URA3 marker. The deletion of PDC5, integration of sadB, and marker removal were confirmed by PCR with primers oBP540 (SEQ ID NO: 1044) and oBP541 (SEQ ID NO: 1045) using genomic DNA prepared with a Gentra Puregene Yeast/Bact kit (Qiagen). The correct isolate was selected as strain CEN.PK 113-7D Δura3::loxP Δhis3 Δpdc6 Δpdc1::ilvDSm Δpdc5::sadB and designated as BP913.

GPD2 Deletion

To delete the endogenous GPD2 coding region, a gpd2::loxP-URA3-loxP cassette (SEQ ID NO: 1057) was PCR-amplified using loxP-URA3-loxP PCR (SEQ ID NO: 1052) as template DNA. loxP-URA3-loxP contains the URA3 marker from (ATCC #77107) flanked by loxP recombinase sites. PCR was done using Phusion DNA polymerase and primers LA512 and LA513 (SEQ ID NOs: 1029 and 1030, respectively). The GPD2 portion of each primer was derived from the 5' region upstream of the GPD2 coding region and 3' region downstream of the coding region such that integration of the loxP-URA3-loxP marker resulted in replacement of the GPD2 coding region. The PCR product was transformed into BP913 and transformants were selected on synthetic complete media lacking uracil supplemented with 1% ethanol (no glucose). Transformants were screened to verify correct integration by PCR using primers oBP582 and AA270 (SEQ ID NOs: 1048 and 1049, respectively).

The URA3 marker was recycled by transformation with pRS423::P$_{GAL1}$-cre (SEQ ID NO: 1011) and plating on synthetic complete media lacking histidine supplemented with 1% ethanol at 30° C. Transformants were streaked on synthetic complete medium supplemented with 1% ethanol and containing 5-fluoro-orotic acid (0.1%) and incubated at 30 C to select for isolates that lost the URA3 marker. 5-FOA resistant isolates were grown in YPE (1% ethanol) for removal of the pRS423::P$_{GAL1}$-cre plasmid. The deletion and marker removal were confirmed by PCR with primers oBP582 (SEQ ID NO: 1048) and oBP591 (SEQ ID NO: 1050). The correct isolate was selected as strain CEN.PK 113-7D Δura3::loxP Δhis3 Δpdc6 Δpdc1::ilvDSm Δpdc5::sadB Δgpd2::loxP and designated as BP1064.

Example 14

Shake Flask Experiment to Measure 2,3-dihydroxyisovalerate Accumulation and Isobutanol Production The purpose of this Example was to show the effect on accumulation of the isobutanol pathway intermediate 2,3-dihydroxyisovalerate (DHIV) and show isobutanol production in isobutanologen strains with an integrated copy of the AFT1-L99A gene or a FRA2 deletion compared to the parent strain. Strains were transformed with isobutanol pathway plasmids pYZ090 (SEQ ID NO: 984; described in U.S. Appl. No. 61/368,436, incorporated by reference herein) and pLH468 (SEQ ID NO: 985; described in U.S. Application No. 61/246,844, incorporated by reference herein). These plasmids are also described briefly, as follows.

pYZ090 (SEQ ID NO: 984) was constructed to contain a chimeric gene having the coding region of the alsS gene from *Bacillus subtilis* (nt position 457-2172) expressed from the yeast CUP1 promoter (nt 2-449) and followed by the CYC1 terminator (nt 2181-2430) for expression of ALS, and a chimeric gene having the coding region of the ilvC gene from *Lactococcus lactis* (nt 3634-4656) expressed from the yeast ILV5 promoter (2433-3626) and followed by the ILV5 terminator (nt 4682-5304) for expression of KARI.

pLH468 (SEQ ID NO: 985) was constructed to contain: a chimeric gene having the coding region of the ilvD gene from *Streptococcus mutans* (nt position 3313-4849) expressed from the *S. cerevisiae* FBA1 promoter (nt 2109-3105) followed by the FBA1 terminator (nt 4858-5857) for expression of DHAD; a chimeric gene having the coding region of codon optimized horse liver alcohol dehydrogenase (nt 6286-7413) expressed from the *S. cerevisiae* GPM1 promoter (nt 7425-8181) followed by the ADH1 terminator (nt 5962-6277) for expression of ADH; and a chimeric gene having the coding region of the codon-optimized kivD gene from *Lactococcus lactis* (nt 9249-10895) expressed from the TDH3 promoter (nt 10896-11918) followed by the TDH3 terminator (nt 8237-9235) for expression of KivD.

A transformant of PNY1503 (parent strain) was designated PNY1504. A transformant of PNY1505 (fra2 deletion strain) was designated PNY1506. Transformants of PNY1541 and PNY1542 (AFT1-L99A integration strains) were designated PNY1543 and PNY1544, for PNY1541, and PNY1545 and PNY1546, for PNY1542.

Strains were grown in synthetic medium (Yeast Nitrogen Base without Amino Acids (Sigma-Aldrich, St. Louis, Mo.) and Yeast Synthetic prop-Out Media Supplement without uracil and histidine (Clontech, Mountain View, Calif.)) supplemented with 100 mM MES pH5.5, 0.2% glucose, and 0.2% ethanol. Overnight cultures were grown in 15 mL of medium in 125 mL vented Erlenmeyer flasks at 30° C., 225 RPM in a New Brunswick Scientific I24 shaker. 18 ml of medium in 125 mL tightly-capped Erlenmeyer flasks was inoculated with overnight culture to an OD$_{600}$ 0.5 and grown for six hours at 30° C., 225 RPM in a New Brunswick Scientific I24 shaker. After six hours, glucose was added to 2.5%, yeast extract was added to 5 g/L, and peptone was added to 10 g/L (time 0 hours). After 24 and 48 hours, culture supernatants (collected using Spin-X centrifuge tube filter units, Costar Cat. No. 8169) were analyzed by HPLC (method described in U.S. Patent Appl. Pub. No. US 2007/0092957, incorporated by reference herein) and LC/MS. Glucose and isobutanol concentrations were determined by HPLC. DHIV was separated and quantified by LC/MS on a Waters (Milford, Mass.) AcquityTQD system, using an Atlantis T3 (part

186003539) column. The column was maintained at 30° C. and the flow rate was 0.5 mL/min. The A mobile phase was 0.1% formic acid in water, and the B mobile phase was 0.1% formic acid in acetonitrile. Each run consisted of 1 min at 99% A, a linear gradient over 1 min to 25% B, followed by 1 min at 99% A. The column effluent was monitored for peaks at m/z=133 (negative ESI), with cone voltage 32.5V, by Waters ACQ_TQD (s/n QBA688) mass spectometry detector. DHIV typically emerged at 1.2 min. Baseline separation was obtained and peak areas for DHIV were converted to µM DHIV concentrations by reference to analyses of standards solutions made from a 1 M aqueous stock.

Table 18 shows the DHIV molar yield (moles of DHIV per moles of glucose consumed) and isobutanol titer of the AFT1-L99A strains (PNY1543, PNY1544, PNY1545, and PNY1546) and the FRA2 deletion strain (PNY1506) compared to the parent strain background (PNY1504) at 24 and 48 hours. AFT1-L99A expression or the FRA2 deletion both led to approximately a 50% decrease in the accumulation of DHIV.

TABLE 18

DHIV molar yield and isobutanol titer.

| Strain | 24 Hr DHIV Yield (mol/mol) | 48 Hr DHIV Yield (mol/mol) | 24 Hr Isobutanol Titer (g/L) | 48 Hr Isobutanol Titer (g/L) |
|---|---|---|---|---|
| PNY1504 | 0.044 | 0.035 | 3.7 | 4.2 |
| PNY1543-PNY1544 | 0.017 | 0.015 | 4.1 | 5.8 |
| PNY1545-PNY1546 | 0.019 | 0.018 | 4.6 | 5.5 |
| PNY1506 | 0.022 | 0.020 | 3.8 | 4.7 |

Data are the average of two independent flasks, for PNY1504 and PNY1506, and two independent transformants for the AFT1-L99A strains (PNY1543-PNY1544 and PNY1545-PNY1546).

The foregoing description of the specific embodiments will so fully reveal the general nature of the invention that others can, by applying knowledge within the skill of the art, readily modify and/or adapt for various applications such specific embodiments, without undue experimentation, without departing from the general concept of the present invention. Therefore, such adaptations and modifications are intended to be within the meaning and range of equivalents of the disclosed embodiments, based on the teaching and guidance presented herein. It is to be understood that the phraseology or terminology herein is for the purpose of description and not of limitation, such that the terminology or phraseology of the present specification is to be interpreted by the skilled artisan in light of the teachings and guidance.

SEQUENCE LISTING (1057 sequences)

SEQ ID NO: 1 - DNA, 1743 bp, Mycobacterium sp.
atgccctcaggaagttcaggaactcccgctgatgctcttcgcgcgagcgactcatcgccggacatcaagccccgcagccgcgacgtcaccgacggcctcgagaagaccgccgcccgcgggatgctgcgggcggtcggcatgggcgacgacgactgggtcaaaccgcagatcggcgtgggttcgtcgtggaacgagatcaccccgtgcaacatgtcgctgcaacggctggcgcagtcggtgaagggcggcgtgcactccgccggcggatttccgctggagttcggcacgatctcggtgtccgacggcatctcgatgggccacgagggcatgcacttctcgctggtctcgcgtgaggtgatcgccgacagcgtcgagaccgtcgtgcaggccgagcgtctcgacggcacggtgctgctggccggctgcgacaagtcgattcccggcatgctgatggccgccgcccggctcgacctggcctcggtcttcctgtacaacggttcgatcatgccgggcgtcgcgaagctcaccgacggctccgagcgggaagtcacgatcatcgacgccttcgaggcggtcggggcgtgcgcccgcgggctgatgtcccgcgaggacgtcgacatcatcgaacgggcgatctgtccgggtgagggcgcctgcggcggtatgtacaccgccaacaccatggcgtcggcggcggaagcgctcggcatgtcgttgccgggcagcgcatctcctgtggccatcgacaagcggcgcgacgagtacgcgcggaagtcgggtgaggcggtcgtcgagatgctgcgccgcggtatcaccgcccgcgacatcctcaccaaggaggccttcgagaacgcgatcgccgtcgtcatggcgttcggcggctccaccaacgccgtgctgcacctgctggccatcgcgtgggaggccaacgtgaagctcaccctcgaggacttcacccgcgtcgggcagaaggtgccgcacctcgccgacgtcaaaccgttcggccgtcacgtcatgaagcacgtcgacgagatcggcggtgtgcccgtggtgatgaaggcgctgctggacgccggactgctgcacggggactgcctcaccatcaccggcgagaccatggccgagaacctggcccacatcgaaccgccggacccggacggcaaggtgctgcgggcgatgaacaacccgatccacccgaccggcggcatcacgatcctgcacggatcgttggcgcccgagggcgcggtcgtgaagtcggcgggcttcgactccgacgtgttcgagggcaccgcaagggttttcgagcgggagcgggcagccctggacgcactcgaggacggcacgatcacccacggcgacgtcgtcgtcatccgctacgagggacccaagggcgggcccgggatgcgcgagatgctcgccatcaccggtgcgatcaagggtgccggcctgggcaaggacgtgctgctgatgaccgacggccggttctccggcggcaccaccggcctgtgcgtcgggcatatcgcccccgaggcggtcgacggcgggcccatcgcgttcgtgcgcgacggcgaccggatccggctcgacgtcgccaagggcacgctggacctcctggtcgacgaggccgaattcgagtcccgcaaagcgggattcgagccgttgcccccggtgtacaccaccggcgtgctggccaagtacacgaagttggtcgggtcggcggcggtcggcgcggtctgcggctag

SEQ ID NO: 2 - protein, 580 aa, Mycobacterium sp.
MPSGSSGTPADALRASDSSPDIKPRSRDVTDGLEKTAARGMLRAVGMGDDDWVKPQIGVGSSWNEITPCNMSLQRLAQSVKGGVHSAGGFPLEFGTISVSDGISMGHEGMHFSLVSREVIADSVETVVQAERLDGTVLLAGCDKSIPGMLMAAARLDLASVFLYNGSIMPGVAKLTDGSEREVTIIDAFEAVGACARGLMSREDVDIIERAICPGEGACGGMYTANTMASAAEALGMSLPGSASPVAIDKRRDEYARKSGEAVVEMLRRGITARDILTKEAFENAIAVVMAFGGSTNAVLHLLAIAWEANVKLTLEDFTRVGQKVPHLADVKPFGRHVMKHVDEIGGVPVVMKALLDAGLLHGDCLTITGETMAENLAHIEPPDPDGKVLRAMNNPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFVRDGDRIRLDVAKGTLDLLVDEAEFESRKAGFEPLPPVYTTGVLAKYTKLVGSAAVGAVCG

SEQ ID NO: 3 - DNA, 1770 bp, Mycobacterium gilvum
atgtggccgatgaatcgacgggcgcataatcaccccatgccctcagactcacgctcgcattctcttcgcgcaagcggctcatcggtcgacatcaaaccccgcagccgcgacgtgaccgacgggctcgagcgcaccgccgcgcgcggcatgctgcgcgcggtcggcatgaccgacgacgactgggtcaagccccagatcggggtcggctcgtcgtggaacgagatcacgccgtgcaacatgtcgctgcagcggctggcccaggcggtcaagggcggtgtgcacgaggccgggggttacccgctggagttcggcacgatctccgtctccgacggcatctcgatgggccacgagggcatgcacttctcgctggtgtcccgcgaggtcatcgccgacagcgtcgagaccgtggtgcaggccgaacgcctcgacggcacggtgttgctggccggctgcgacaagtcgatccccggcatgctgatggccgcggcccgcctcgatctggcgagcgtgttcttctacaacggctcgatcatgccgggcgtcgcgaagctcaccgacggaagcgagaaggaagtcacgatcatcgacgccttcgaggcggtcggtgcgtgtgcgcgcgggctgatgtcgcgggaggacgtcgacatcatcgagcgggccatctgccccggtgagggcgcctgcggtggcatgtacaccgccaacacgatggcctcggccgccgaggcgctcggcatgtcgctgccgggcagcgcgtctccggtggcgatcgacaagcggcgcgacgactttgcgcgccgctccggcgaggcggtggtcgagatgctgcgtcgcggcatcaccgcccgcgacatcctgaccaaggaggccttcgagaacgcgatcgccgtcgtgatggccttcggcggttccaccaacgcggtgctgcatctgctggccatcgcgtgggaggcgcaggtcgagctgacgctggcggacttcacccggatcgggcagaaggtgccgcacctggcggatgtgaagccgttcggcgcgtacgtgatgaagcacgtcgacgagatcggcggcgtgccggtggtgatgcgggcactgctcgacgccggactgctgcacggggactgcctcacggtgaccggtcagacgatggccgagaacctggcccacatcgagccgccggaccccgacggcaaggtgctgcgggcgatgaacaacccgatccacccgaccggcggcatcacgatcctgcacggatcgctggcccccgagggcgcggtggtcaagtcggccggcttcgactccgacgtgttcgagggcaccgcacgggttttcgagcgcgaacgggcggcgctcgacgcgctggaggacggcacgatcacccacggcgacgtcgtcgtcatccgttacgagggccccaagggcggcccggggatgcgcgagatgctggcgatcaccggtgcgatcaagggcgccgggctgggcaaggacgtgctgctgatgaccgacggacggttctcgggcgggacgacgggtctgtgcgtcgggcacatcgcgccggaggccgtcgacggcggaccgatcgcattcgtgcgtgacggggacaggatccggttggacgtcgccaacggcacgctggacatcctcgtcgacgaggccgagttcgaatcgcgcaaggcgggcttcgaaccgctgccgccggtctacacgacgggggtgctcgccaagtacacgaagctggtgggttcggcggcggtcggcgcggtctgcagttag

SEQ ID NO: 4 - protein, 589 aa, Mycobacterium gilvum
MWPMNRRAHNHPMPSDSRSHSLRASGSSVDIKPRSRDVTDGLERTAARGMLRAVGMTDDDWVKPQIGVGSSWNEITPCNMSLQRLAQAVKGGVHEAGGYPLEFGTISVSDGISMGHEGMHFSLVSREVIADSVETVVQAERLDGTVLLAGCDKSIPGMLMAAARLDLASVFFYNGSIMPGVAKLTDGSEKEVTIIDAFEAVGACARGLMSREDVDIIERAICPGEGACGGMYTANTMASAAEALGMSLPGSASPVAIDKRRDDFARRSGEAVVEMLRRGITARDILTKEAFENAIAVVMAFGGSTNAVLHLLAIAWEAQVELTLADFTRIGQKVPHLADVKPFGAYVMKHVDEIGGVPVVMRALLDAGLLHGDCLTVTGQTMAENLAHIEPPDPDGKVLRAMNNPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFVRDGDRIRLDVANGTLDILVDEAEFESRKAGFEPLPPVYTTGVLAKYTKLVGSAAVGAVCS

SEQ ID NO: 5 - DNA, 1716 bp, Mycobacterium smegmatis
atgccctcagacgacaagtccactgagactcctgacatcaagccccgcagtcgcgacgtcaccgacggcctcgagaaggcggccgcccgtgggatgctccgtgcggtaggcatgggcgacgccgactgggccaagccgcagatcggcgtcgggtcgtcgtggaacgagatcacgccgtgcaacatgtcgctgcagcgcctcgcgaagtcggtcaaggacggcgtccacgaggcgggcggctacccgctcgaattcggcaccatctcggtgtccgacggcatctcgatgggccacgagggcatgcacttctcgctggtctcgcgcgaggtgatcgccgacagcgtcgagaccgtcgtgcaggccgagcgcctcgacggcacggtcctgctggccggctgcgacaagtccattccgggcatgctcatggctgccgcgcggctggacctcgcctcggtgttcttctacaacggctcgatcatgccgggtgtcgcgaagctgaccgacggcaccgagaaggaagtcacgatcatcgacgcgttcgaggccgtcggcgcgtgcgtgcgcggcctgatgtcgcgtgaggacgtcgacatcatcgagcgcgcgatctgccccggcgagggtgcctgcggcggcatgtacaccgccaacaccatggccagcgccgccgaggccctcggcctgtcgctgcccggcagcgcgtcgccggtcgccatcgacaagcgccgcgacgagttcgcgcgccgctccggcgaggccgtcgtcgacatgctgcgtcgcggcatcaccgctcgcgacatcctcaccaaggaggccttcgagaacgccatcgccgtggtcatggcgttcggcgggtccaccaacgccgtgctgcacctgctggcgatcgcccgcgaggccgaggtggagctgacgctcgacgatttcacgcgcgtcggcagcaaggtcccgcacctcgcggacgtcaagccgttcggccgccatgtcatgaagcacgtcgacgagatcggcggtgtgcccgtggtgatgcgcgctctgctggatgccggtctgctgaacggcgagtgcctgacggtcacgggcaagaccatggccgagaacctggcccacatcgctcccccggatcccgacggcaaggtgctgcgggccatgaacaacccgatccacccgaccggcggcatcacgatcctgcacggctcgctcgctcccgagggtgcggtggtcaagtcagccggcttcgattcggacgtgttcgagggcactgcaagggttttcgaccgcgaacgtgccgcgatggacgcgctcgaggacggcaccatccaggcgggcgacgtcgtggtgatccgctacgagggccccaagggcggtcccggtatgcgcgagatgctcgcgatcaccggcgccatcaagggtgcgggtctgggcaaggacgtgctgctgatgaccgacggtcggttctcgggcggtacgacgggtctgtgcgtcgggcacatcgcgccggaggccgtcgacggcggcccgatcgcgttcgtgcgcgacggtgaccgcatccgcctcgacgtcgccaagggcacgctcgacgtgctcgtcgacgaagaagagttcgaggcccgcaaggccggcttcgaacccctgccgccgcggtacaagaccggtgtgctggccaagtacaccaagctggtccagtccgccgccgtcggcgcagtctgcacctaa

SEQ ID NO: 6 - protein, 571 aa, Mycobacterium smegmatis
MPSDDKSTETPDIKPRSRDVTDGLEKAAARGMLRAVGMGDADWAKPQIGVGSSWNEITPCNMSLQRLAKSVKDGVHEAGGYPLEFGTISVSDGISMGHEGMHFSLVSREVIADSVETVVQAERLDGTVLLAGCDKSIPGMLMAAARLDLASVFFYNGSIMPGVAKLTDGTEKEVTIIDAFEAVGACVRGLMSREDVDIIERAICPGEGACGGMYTANTMASAAEALGLSLPGSASPVAIDKRRDEFARRSGEAVVDMLRRGITARDILTKEAFENAIAVVMAFGGSTNAVLHLLAIAREAEVELTLDDFTRVGSKVPHLADVKPFGRHVMKHVDEIGGVPVVMRALLDAGLLNGECLTVTGKTMAENLAHIAPPDPDGKVLRAMNNPIHPTGGITILHGSLAPEGAVVKSAGFDSDVFEGTARVFDRERAAMDALEDGTIQAGDVVVIRYEGPKGGPGMREMLAITGAIKGAGLGKDVLLMTDGRFSGGTTGLCVGHIAPEAVDGGPIAFVRDGDRIRLDVAKGTLDVLVDEEEFEARKAGFEPLPPRYKTGVLAKYTKLVQSAAVGAVCT

SEQ ID NO: 7 - DNA, 1698 bp, Mycobacterium vanbaalenii
atgccctcatcgccagacatcaagccccgtagccgcgacgtcaccgacggcctggagaaggccgccgcccggggaatgctgcgcgcggtaggcatgggcgacgaggacttcgccaaaccgcagatcggcgtcggctcgtcctggaacgagatcaccccgtgcaacctgtcgctggaccggctcgccaaggcggtcaaggaaggcgtcttcgaggccggcggcttcccgatggagttcggcaccatctcggtttccgacggcatctcgatgggccatgaaggcatgcacttttcgttggtgtcgcgcgagatcatcgccgacagcgtcgagacggtgatgcaggccgagcgtctggacggctcggtgctgctcgccggatgcgacaagtcgctgcccggcatgctgatggccgctgcgcggctcgacctggccagcgtttttctctacgccggctcgatcctgcccggccgggtcaagctgtccgacggcagcgagaaggacgtcacgatcatcgacgccttcgaggccgtcggcgcctgcgcgcgcgggctgatgccccgcgaggacgtcgacgccatcgagcgtgcgatctgcccgggtgaaggcgcctgcggcggcatgtacaccgccaacacgatggccagcgccgccgaggcgctcggcatgtcgctgcccggctccgccgccccgccggccaccgaccggcgccgcgacggcttcgcccgcaagagcggcatggccgtcgtcgaactgctgcgccgaggcatcaccgcccgcgacatcctgaccaaggaggcgttcgagaacgcgatcgcggtcgtgatggcgttcggcggctccaccaacgcggtgctgcacctgctcgcgatcgcctacgaggccaacgtcaagctgaccctggaggacttcacccgcgtcggcgccaaggtgccgcacctggccgacgtgaaaccgttcggcgcgtacgtgatgaacgacgtcgaccggatcggcggcgttccggtcgtgatgaaggctctgctggacgccggtctgctgcacggggactgcctcaccgtcaccggtaagacgatggccgagaaccttgcccacatcgccccgcccgaccccgacggcaaggtgctgcgcgctctcagcaggccgatccatcccaccggcggcatcacgatcctgcacggctcgctggctcccgaaggtgcggtggtgaagtccgccgggttcgactccgacgtgttcgaaggcaccgcaagggttttcgagcgtgaacgggcagcgctcgacgcgctggaggacggcaccatcacgcacggcgacgtcgtggtcatccgttacgagggccccaagggcggtccgggcatgcgcgaaatgctcgccatcacaggcgcaatcaagggcgccgggctcggcaaggatgtgctgttgatgaccgacggccggttctccggcggcaccaccggtctgtgcgtcggccacatcgccccggaagcggtcgacggcggacccatcgccttcatcaaggacggcgacaagatccgtctcgacgtggccaagggcaccctcgacgttgtggtcgacaaggacgaattcgaggcgcgcaaagtcgggttcgagccgcttccccccgtctacaccaccggggtgctggccaagtacaccaagctcgtcggctcggcggccaccggcgcggtctgcacgtag

SEQ ID NO: 8 - protein, 565 aa, Mycobacterium vanbaalenii
MPSSPDIKPRSRDVTDGLEKAAARGMLRAVGMGDEDFAKPQIGVGSSWNEITPCNLSLDRLAKAVKEGVFEAGGFPMEFGTISVSDGISMGHEGMHFSLVSREIIADSVETVMQAERLDGSVLLAGCDKSLPGMLMAAARLDLASVFLYAGSILPGRVKLSDGSEKDVTIIDAFEAVGACARGLMPREDVDAIERAICPGEGACGGMYTANTMASAAEALGMSLPGSAAPPATDRRRDGFARKSGMAVVELLRRGITARDILTKEAFENAIAVVMAFGGSTNAVLHLLAIAYEANVKLTLEDFTRVGAKVPHLADVKPFGAYVMNDVDRIGGVPVVMKALLDAGLLHGDCLTVTGKTMAENLAHIAPPDPDGKVLRALSRPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFIKDGDKIRLDVAKGTLDVVVDKDEFEARKVGFEPLPPVYTTGVLAKYTKLVGSAATGAVCT

SEQ ID NO: 9 - DNA, 1707 bp, Nocardia farcinica
gtggccgagcagacgaacacccccgacctcaagccccgcagccgcgacgtcaccgacgggctggaacgcaccgccgcccgcggcatgctgcgcgcggtgggcatgggcgacgacgactgggagaagccgcagatcggcgtcgcctcctcctggaacgagatcaccccgtgcaacctgtcgctggaccggctcgcgcagggctgcaaggacggcgtgttcgccgccggtggcttcccgatgcagttcggcaccatctcggtctccgacggcatctcgatgggccacgagggcatgcacttctcgctggtgtcgcgcgaagtgatcgccgacagcgtggagacggtgatgcaggccgagcggctcgacggctcggtgctgctggccgggtgcgacaagtcgctgcccggcatgctgatggccgcggcccgcctcgacctggccagcgtgttcctctacgcgggctcgatcctgcccggcatcgccaagctctccgacggcaccgagcgcgaggtgacgatcatcgacgcgttcgaggcggtcggagcgtgcgcgcgcgggctgatgagccgggccgacgtcgacgccatcgaacgcgcgatctgtcccggcgagggcgcctgcggcggcatgtacaccgccaacacgatggccagcgcggccgaggcgctgggcatgtcgctgcccggcagcgccgcaccgcccgccaccgaccgccgccgcgacgggtacgcccgccgcagcggtcaggccgtggtcgagctgctgcgccgcggcatcaccgcccgcgacatcctcaccaaggaggcgttcgagaacgccatcgcggtggtgatggccttcggcggctcgaccaacgcggtgctgcacttgctcgcgatcgcgcacgaggcgcgggtggagctcaccctcgacgatttcgcgcgggtgggcaggcgggtgccgcacctggccgacgtcaagccgttcggcgcgcatgtgatgaccgatgtcgaccgcatcggcggcgtgccggtgatgatgaagaccctgctcgacgccgggctgctgcacggtgactgcctcaccgtcaccggccgcaccgtcgcggagaacctcgcccacatcgccccgcccgacccggacggcaaggtggtgcgcgcgctgaacgatccgatccatcccaccggcggcatcaccatcctgtccggctcgctggcgcccggcggggcggtggtgaaatccgccggtttcgacgaggacgtcttcaccggcacggccagggtcttcgatcgcgaacgcgccgcgatggacgcgctcgaggacggcaccatcaccgcaggcgacgtggtggtcatccgctacgagggccccaagggcggacccggcatgcgcgagatgctggccatcaccgccgccatcaagggcgcgggcctgggcaaggacgtgctgctgctcaccgacggccgcttctccggtggcaccaccggactgtgtgtcgggcacgtcgcgcccgaggcggtggacggtggtccgatcgcgttcgtccgcgacggcgaccgcatccggctcgacgtggccgcgggcaccctggacctgctggtggagcccgccgaactcgagcggcgcaaacaggactggcgaccgctgccgccgcgctacacccgcggcgtgctcgccaagtacaccaagctggtcggttcggcctcggtcggcgcggtctgcgactga

SEQ ID NO: 10 - protein, 568 aa, Nocardia farcinica
MAEQTNTPDLKPRSRDVTDGLERTAARGMLRAVGMGDDDWEKPQIGVASSWNEITPCNLSLDRLAQGCKDGVFAAGGFPMQFGTISVSDGISMGHEGMHFSLVSREVIADSVETVMQAERLDGSVLLAGCDKSLPGMLMAAARLDLASVFLYAGSILPGIAKLSDGTEREVTIIDAFEAVGACARGLMSRADVDAIERAICPGEGACGGMYTANTMASAAEALGMSLPGSAAPPATDRRRDGYARRSGQAVVELLRRGITARDILTKEAFENAIAVVMAFGGSTNAVLHLLAIAHEARVELTLDDFARVGRRVPHLADVKPFGAHVMTDVDRIGGVPVMMKTLLDAGLLHGDCLTVTGRTVAENLAHIAPPDPDGKVVRALNDPIHPTGGITILSGSLAPGGAVVKSAGFDEDVFTGTARVFDRERAAMDALEDGTITAGDVVVIRYEGPKGGPGMREMLAITAAIKGAGLGKDVLLLTDGRFSGGTTGLCVGHVAPEAVDGGPIAFVRDGDRIRLDVAAGTLDLLVEPAELERRKQDWRPLPPRYTRGVLAKYTKLVGSASVGAVCD

SEQ ID NO: 11 - DNA, 1695 bp, Rhodococcus sp.
atgagtaccccggatcccaaaccccgcagccgtgacgtcaccgacggattggagaagaccgcagcgcgcggaatgctccgtgcggtgggcatgggcgacgacgactgggggaaatcccagatcggcgtggcgtcgtcctggaacgagatcaccccctgcaacctgtcgctcgaccggctcgcgaaggccgtcaaggacggcgtccacgccgcaggcgggtatcccctcgagttcggcaccatctccgtgtccgacggcatctcgatgggacacgagggcatgcacttctccctcgtctcccgtgaggtgatcgccgacagcgtggaaacggtgatgcaggccgaacgcctcgacgggtcggtgctcctcgccggttgcgacaagtccctgcccggcatgctgatggccgcggcccgcctcgacctcgcgagcgtgttcctctacgccggttcgatcctgcccggtgtcgcaaaaatgtccgacggcaccgaacgcgacgtcaccatcatcgacgcgttcgaggcggtcggcgcctgttcgcgcggactgatgagccgtgaggacgtcgacgccatcgagcgtgccatctgtcccggcgagggcgcgtgcggcggaatgtacaccgcgaacacgatggccagtgccgccgaggcgctcggcatgtcgctgcccggcagcgcctccccgcccgccaccgaccgtcgtcgcgacggattcgcgaggcgcagcggtgaagccgtcgtcgaactgctccgccgcggcatcaccgccagggacatcctcaccaaggaagcgttcgagaacgccatcgccgtggtcatggccttcggcggttccaccaacgccgtcctgcacctgctggcgatcgcgagcgaagcggatgtggaactgaccctcgacgacttctcccgcgtcggcgcccgcgtcccgcacctcgcggacgtcaaaccgttcggcaagcacgtgatgaaggacgtcgaccacatcggcggcgtccccgtcatcatgaaggccctgctcgacgccgggatgctgcacggcgactgcctcaccgtcaccggcaagaccatggccgagaacctgtcggccatcgcccctcccgacccggacggcaaggtgctccgcgcgatgagttcgcccatccacccgaccggcggaatcacgatcctcaaggggtccctcgccccgggcggcgcggtggtgaagtcggccgggttcgactccgacgtcttcaccggcaccgcccgcgtcttcgaacgggaacgcgccgcgatggatgccctcgaggacggcaccatcacgaacggcgacgtcgtggtcatccgctacgagggccccaagggcggtcccggcatgcgcgagatgctcgcgatcaccggcgcgatcaagggcgccgggctgggcaaggacgtcctcctgctcaccgacggccgattctccggcggcaccaccggcctgtgcgtcggccacgtggcaccggaagccgtcgacggcggtcccatcgcgttcgtccgcgacggcgaccagatccgactggacgtcggaacgggcaccctcgaactgctcgtcgacgaagaggaactcgccggccgcaagaacgggtgggagcctctgcccccgcgctacacccgcggggtcctggccaagtacacgaagctcgtcggttccgcctcgggcggcgccgtctgcgggtag

SEQ ID NO: 12 - protein, 564 aa, Rhodococcus sp.
MSTPDPKPRSRDVTDGLEKTAARGMLRAVGMGDDDWGKSQIGVASSWNEITPCNLSLDRLAKAVKDGVHAAGGYPLEFGTISVSDGISMGHEGMHFSLVSREVIADSVETVMQAERLDGSVLLAGCDKSLPGMLMAAARLDLASVFLYAGSILPGVAKMSDGTERDVTIIDAFEAVGACSRGLMSREDVDAIERAICPGEGACGGMYTANTMASAAEALGMSLPGSASPPATDRRRDGFARRSGEAVVELLRRGITARDILTKEAFENAIAVVMAFGGSTNAVLHLLAIASEADVELTLDDFSRVGARVPHLADVKPFGKHVMKDVDHIGGVPVIMKALLDAGMLHGDCLTVTGKTMAENLSAIAPPDPDGKVLRAMSSPIHPTGGITILKGSLAPGGAVVKSAGFDSDVFTGTARVFERERAAMDALEDGTITNGDVVVIRYEGPKGGPGMREMLAITGAIKGAGLGKDVLLLTDGRFSGGTTGLCVGHVAPEAVDGGPIAFVRDGDQIRLDVGTGTLELLVDEEELAGRKNGWEPLPPRYTRGVLAKYTKLVGSASGGAVCG

SEQ ID NO: 13 - DNA, 1695 bp, Mycobacterium ulcerans
atgccagaagccgatatcaagccccgtagccgcgacgtcactgacggactggaaaaagccgctgcccgtggcatgttgcgggcggtaggcatggtcgacgaagacttcgccaaggcacagatcggggttgcctcgtcctggaacgagattacgccgtgcaacctctcgctggaccggctggccaagtcggtgaaagagggggtgttcgccgcgggcggctacccgcttgagttcggcacgatttcggtctccgacggcatttcgatgggtcacgagggcatgcacttctccctggtgtcgcgcgaagtgatcgccgacagcgtggaaaccgtgatgcaggccgagcgcctcgacggctcggtgctgctggccggatgcgacaaatccctgcccggaatgctgatggccgccgcccgtttggatttggcgtcggtgtttctctacgcgggctcgatccttccgggggtcgccaagctctccgacggcagcgaacgcgaggtcaccatcatcgacgcgttcgaagcggtcggcgcgtgctcgcgagggttgatgagccgagccgacgtcgacgccatcgagcgcgcgatctgccccggcgagggtgcctgtggcgggatgtacacggccaacacgatggccagtgccgctgaagcacttggcatgtcgctgccgggcagcgcggcgcccccggccaccgaccgccgccgcgacgggttcgcccggcaaagcggtcaagccgtcatcgaattgctgcgccagggcattaccgctcgcgacatcatgacccgggaggcgttcgagaacgccatcgcggtggtgatggcattcggcggctcgaccaatgcggtgctgcacctgctggcgatcgcccatgaggccaacgtcgagctcacgctcgacgacttcagccggatcggctcgaaggtgccgcacctagccgatgtcaagccgttcggccgccatgtgatgtcccacgtcgaccacatcggcggtgtgccggtggtcatgaagactttgctggatgccggcctgctgcacggggattgcctgaccgtgaccggccggaccgtggccgagaacctggaggccattgctccgccggacccggacggcaaggtgctacgcgcgctgatcaacccgatccatgcgaccgggggcatcaccatcctgcgtggatccctggcccccgaaggtgccgtggtcaagacggccggcttggacaccgatgtattcgaaggaacggcacgggttttcgacggcgagcgggccgcgctggatgccctcgaggacggcaccatcacccacggtgacgtggtggtgatccgttacgagggacccaagggcggccccgggatgcgggagatgctcgccatcaccggcgcgatcaagggcgccgggctcggcaaagacgtgctgctgttgaccgacggtcgattctccggcggcacaacgggcttctgtgtgggacacatcgcacccgaggcggtggatgccggaccgatcgcgttcgtgcgcgacggcgaccggatccggctcgacgttgccggccggacgctcgacgttctgaccgacccgccagagttcgcggcccgtcaacagaatttcactcctccggcgccgcgttacaagaccggcgtactggccaagtacgtcaagctggtcggctccgccgcgatcggcgcggtctgcggctaa

SEQ ID NO: 14 - protein, 564 aa, Mycobacterium ulcerans
MPEADIKPRSRDVTDGLEKAAARGMLRAVGMVDEDFAKAQIGVASSWNEITPCNLSLDRLAKSVKEGVFAAGGYPLEFGTISVSDGISMGHEGMHFSLVSREVIADSVETVMQAERLDGSVLLAGCDKSLPGMLMAAARLDLASVFLYAGSILPGVAKLSDGSEREVTIIDAFEAVGACSRGLMSRADVDAIERAICPGEGACGGMYTANTMASAAEALGMSLPGSAAPPATDRRRDGFARQSGQAVIELLRQGITARDIMTREAFENAIAVVMAFGGSTNAVLHLLAIAHEANVELTLDDFSRIGSKVPHLADVKPFGRHVMSHVDHIGGVPVVMKTLLDAGLLHGDCLTVTGRTVAENLEAIAPPDPDGKVLRALINPIHATGGITILRGSLAPEGAVVKTAGLDTDVFEGTARVFDGERAALDALEDGTITHGDVVVIRYEGPKGGPGMREMLAITGAIKGAGLGKDVLLLTDGRFSGGTTGFCVGHIAPEAVDAGPIAFVRDGDRIRLDVAGRTLDVLTDPPEFAARQQNFTPPAPRYKTGVLAKYVKLVGSAAIGAVCG

SEQ ID NO: 15 - DNA, 1728 bp, Mycobacterium avium
atgcccaccaccgattcggcgcgcgccgccgacatcaagcagcccgacatcaagccgcgcagtcgtgacgtcaccgacggcctggagaaggccgccgcccgggggatgctgcgggcggtaggcatgggcgacgaggacttcgccaagccgcagatcggggtggcgtcgtcctggaacgagatcacgccgtgcaacctgtcgctggaccggctggccaaggcggtcaaggaaggcgtcttcgccgcgggcggctacccgctggagttcggcaccatctcggtgtccgacggcatctcgatgggccacgagggcatgcacttctcgctggtgagccgcgaggtgatcgccgacagcgtcgagacggtgatgcaggccgagcgcctggacggctcggtgctgctggccggctgcgacaagtcgctgcccggcatgctgatggccgcggcccgcctggacctggcctcggtgttcctctacgccggctcgatcctgcccggggtggccaagctgtccgacggcagcgagcgcgaggtgacgatcatcgacgcgttcgaggccgtcggcgcgtgcgcgcgcgggctgatgccgcgcgaggacgtcgacgccatcgagcgggccatctgtcccggcgagggcgcctgcggcggcatgtacacggccaacaccatggccagcgccgccgaggcgctggggatgtcgctgccgggcagcgcggccccgccggccaccgaccgccgccgcgacggcttcgcccggcgcagcggccaggccgtcgtcgagctgctgcgccgcggcatcaccgcccgcgacatcctcaccaaggaggcgttcgagaacgcgatcgcggtggtgatggcgttcggcggctccaccaacgcggtgctgcacctgctggccatcgcccacgaggccgacgtggcgctgtcgctcgacgacttcagccggatcgggtcgaaggtgccgcacctggccgacgtcaagccgttcggccggcacgtgatgaccgacgtcgaccacatcggcggcgtgccggtgatgatgaaggcgctgctggacgccgggctgctgaacggcgactgcctgacggtgaccggtgcgacggtggcgcagaacctggccgcgatcgccccgcccgacccggacggcaaggtgctgcgggcactcagcgatccgttgcacccgaccggcggcatcaccatcctgcgcgggtcgctggcgcccgagggcgcggtggtcaagtccgccggcttcgattccgacgtgttcgaaggcaccgcaagggttttcgacggcgagcgggccgcgctggacgcgctggaggacggcaccatcaccaagggcgacgcggtggtgatccggtacgagggccccaagggcgggcccgggatgcgcgagatgctcgccatcaccggcgcgatcaagggcgccgggctgggtaaggacgtgctgttactcaccgacggccgcttctccggcgggacgacgggactgtgtgtcggccacatcgcgcccgaggcggtggacgcagggccgatcgcctttctgcgcgacggcgaccgcatccgcctggacgtcgccaaccgggttctggacgtactcgtcgatccggccgaattcgactctcggcgaacaggtttcaccccgccgccgccccgctacaagaccggggtgctggccaagtacgtcaagctcgtcggttccgcggcgatcggcgccgtctgcggctag

SEQ ID NO: 16 - protein, 575 aa, Mycobacterium avium
MPTTDSARAADIKQPDIKPRSRDVTDGLEKAAARGMLRAVGMGDEDFAKPQIGVASSWNEITPCNLSLDRLAKAVKEGVFAAGGYPLEFGTISVSDGISMGHEGMHFSLVSREVIADSVETVMQAERLDGSVLLAGCDKSLPGMLMAAARLDLASVFLYAGSILPGVAKLSDGSEREVTIIDAFEAVGACARGLMPREDVDAIERAICPGEGACGGMYTANTMASAAEALGMSLPGSAAPPATDRRRDGFARRSGQAVVELLRRGITARDILTKEAFENAIAVVMAFGGSTNAVLHLLAIAHEADVALSLDDFSRIGSKVPHLADVKPFGRHVMTDVDHIGGVPVMMKALLDAGLLNGDCLTVTGATVAQNLAAIAPPDPDGKVLRALSDPLHPTGGITILRGSLAPEGAVVKSAGFDSDVFEGTARVFDGERAALDALEDGTITKGDAVVIRYEGPKGGPGMREMLAITGAIKGAGLGKDVLLLTDGRFSGGTTGLCVGHIAPEAVDAGPIAFLRDGDRIRLDVANRVLDVLVDPAEFDSRRTGFTPPPPRYKTGVLAKYVKLVGSAAIGAVCG

SEQ ID NO: 17 - DNA, 1728 bp, Mycobacterium tuberculosis
atgccgcaaaccaccgacgaagccgcttccgtctcgacggtcgccgacatcaagccccgcagtcgagacgtcaccgacggcctggagaaggccgctgcccggggcatgttgagggcggtgggcatggacgacgaagacttcgcgaagccacagatcggggtcgcgtcgtcgtggaacgaaatcacgccgtgcaatctctcattggaccggctggccaacgcggtcaaggagggggtgttttcggccggcggctatccgcttgagttcggcacgatctcggtttcggacggcatctccatgggtcatgaggggatgcacttctcgctggtttcccgtgaggtgatcgccgacagcgtcgaagtcgtgatgcaggccgaacgactcgacggttcggtgctgctggccggatgcgacaaatcgctgcccggaatgctgatggccgccgcacgactggatctggcggcggtgttcctctacgcgggctctattttgcccggccgggccaagctctccgacggtagcgaacgagacgtcaccatcattgacgccttcgaggcggtcggagcgtgctctcgcggtttgatgagtcgcgccgacgtcgatgccatcgagcgggcaatctgccccggcgaaggggcatgcggcggcatgtacaccgctaacaccatggccagcgccgccgaggcgctcggcatgtcgttgccgggcagcgcggcaccgccggcgaccgaccgccggcgcgacgggttcgcgcgtcgcagcgggcaggccgtcgtcgagctgctgcgccgcggcatcaccgcccgcgacatcctcaccaaggaggcgttcgagaacgccatcgcggtgggaatggcgttcggcggctcgaccaacgcggtgctgcatctgctggccatcgcccacgaggccaacgtcgcactatcgcttcaggacttcagccggatcgggtcgggggtgccgcatttggccgatgtcaagccgttcggccgccatgtgatgtccgacgtcgatcacatcggcggtgtgccggtggttatgaaggcgctgctggacgccggtctgctacacggcgactgcctgacggttaccggtcacaccatggccgagaatctggctgccatcaccccgccggatccagatggcaaggtgctacgtgcgttggcaaacccgatccacccgagcggtggcatcaccatcctgcacggatcgctggcacccgaaggtgcggtggtcaagaccgccggattcgattccgacgtattcgaaggcaccgcaagagttttcgacggcgagcgcgctgcgctggacgcccttgaggatggcaccattaccgtgggcgacgccgtggtaatccggtacgaaggacccaagggcggccccgggatgcgcgaaatgctcgccatcacaggcgcgatcaaaggcgcaggactcggtaaagatgttctactgctgaccgacggccggttctccggtggaaccaccggcctgtgcgttggccacatcgcaccggaggcggtcgacggcggaccgatcgcacttctgcgcaacggcgaccggatccggctcgacgtggccggccgcgttctcgatgtgttggccgatccggccgaattcgcgtcccgacaacaggatttcagtcctccaccgccgcgctacactactggcgtactgtccaagtacgtcaagctggtcagctctgccgcggtcggcgcggtctgcggctag

SEQ ID NO: 18 - protein, 575 aa, Mycobacterium tuberculosis
MPQTTDEAASVSTVADIKPRSRDVTDGLEKAAARGMLRAVGMDDEDFAKPQIGVASSWNEITPCNLSLDRLANAVKEGVFSAGGYPLEFGTISVSDGISMGHEGMHFSLVSREVIADSVEVVMQAERLDGSVLLAGCDKSLPGMLMAAARLDLAAVFLYAGSILPGRAKLSDGSERDVTIIDAFEAVGACSRGLMSRADVDAIERAICPGEGACGGMYTANTMASAAEALGMSLPGSAAPPATDRRRDGFARRSGQAVVELLRRGITARDILTKEAFENAIAVGMAFGGSTNAVLHLLAIAHEANVALSLQDFSRIGSGVPHLADVKPFGRHVMSDVDHIGGVPVVMKALLDAGLLHGDCLTVTGHTMAENLAAITPPDPDGKVLRALANPIHPSGGITILHGSLAPEGAVVKTAGFDSDVFEGTARVFDGERAALDALEDGTITVGDAVVIRYEGPKGGPGMREMLAITGAIKGAGLGKDVLLLTDGRFSGGTTGLCVGHIAPEAVDGGPIALLRNGDRIRLDVAGRVLDVLADPAEFASRQQDFSPPPPRYTTGVLSKYVKLVSSAAVGAVCG

SEQ ID NO: 19 - DNA, 1695 bp, Mycobacterium lepraea
atgatgccccctgacatcaaaccccgcagccgcgacgttaccgatggcctggagaaggccgctgctcgtggcatgttgcgcgcagtcggcatgaacgatgacgacttcgccaaggcgcagatcggagttgcgtcatcatggaacgagatcacaccttgcaatctctcgctggaccgcctggccaaggcggtcaaggagggggtattctcggccggcggttatccgcttgagttcggaacaatttcggtttccgacggcatctcgatggggcaccaggggatgcacttctcgctggtgtcgcgcgaggttatagcggacagcgtcgaaaccgtaatgcaggccgagcgcctcgacggctcagtgcttttggctggctgcgataaatcactacccggaatgctgatggccgccgcacgtctcgacctcgcgtcggtatttctctacgccggctcgatcttgcccggacgaaccaagctctccgacggcaccgaacacgaagtcacgctcatcgacgcattcgaagcggtcggcgcgtgttctcgcggattaatgccccgcgctgatgtcgacgccatcgagcgggcgatctgccccggcgagggggcatgcggtggcatgtacactgccaacactatggccagcgcagcagaggcgctgggtatgtccttgccgggcagcgctgcgccgccggcaacagaccgtcgccgtgatggcttcgcgcggcgtagcgggcaggccgtcatcgaactgctgcgtcgcggtataaccgctcgcgacatccttaccaaggaagcgtttgagaacgcgatcgcggtggtgatggcgttcggtggctcgaccaacgcgatcctgcatctactggccattgcccatgaggccgacgtcaccttgtcgctcgaggacttcagtcggatcggatttaaggtgccgcatatagccgacgttaagccgttcggccggcacgtgatgttcgacgtcgaccacatcggtggtgtgccggtggtaatgaaagcacttctggacgcaggtctactgcacggtgattgcctgacggtgaccggtcagacgatggccgagaacctagcctccattgccccgccagacccggatggccaggtgatccgcacgttgcataatccaattcatccgacgggaggcattacgatcctgcgtggatcgttggcacctgatggcgcggtggttaagacggctggactcgactccgatgtgttcgaaggaactgcaagggttttcgacggagaacgggccgcgttggacgcactcaaggacggcaccatcgccaaaggcgatgttgtggttatccgctatgaaggcccgaaaggcggcccggggatgcgcgaaatgctagccatcaccggtgccatcaaaggtgccgggctaggcaaagatgttctgctacttactgacggcaggttctctggcggaacgaccggcttttgcgtaggacacatcgcgccggaagctgtcgaagcgggaccaatcgcattcctgcgtgacggcgaccgggtcctgctagacgttgtcggctgctccctcgatgtgctggtcgatccagtcgaattttcctctcggaaaaaggatttcattcctcctgcgccacgctacaccaccggtgtgcttgccaagtacgtcaagctcgtcagttcggcgacggtcggcgcggtctgcggttag

SEQ ID NO: 20 - protein, 564 aa, Mycobacterium lepraea
MMPPDIKPRSRDVTDGLEKAAARGMLRAVGMNDDDFAKAQIGVASSWNEITPCNLSLDRLAKAVKEGVFSAGGYPLEFGTISVSDGISMGHQGMHFSLVSREVIADSVETVMQAERLDGSVLLAGCDKSLPGMLMAAARLDLASVFLYAGSILPGRTKLSDGTEHEVTLIDAFEAVGACSRGLMPRADVDAIERAICPGEGACGGMYTANTMASAAEALGMSLPGSAAPPATDRRRDGFARRSGQAVIELLRRGITARDILTKEAFENAIAVVMAFGGSTNAILHLLAIAHEADVTLSLEDFSRIGFKVPHIADVKPFGRHVMFDVDHIGGVPVVMKALLDAGLLHGDCLTVTGQTMAENLASIAPPDPDGQVIRTLHNPIHPTGGITILRGSLAPDGAVVKTAGLDSDVFEGTARVFDGERAALDALKDGTIAKGDVVVIRYEGPKGGPGMREMLAITGAIKGAGLGKDVLLLTDGRFSGGTTGFCVGHIAPEAVEAGPIAFLRDGDRVLLDVVGCSLDVLVDPVEFSSRKKDFIPPAPRYTTGVLAKYVKLVSSATVGAVCG

SEQ ID NO: 21 - DNA, 1692 bp, Kineococcus radiotolerans
gtgagcgtcgacatcaagccccgcagtcgccaggtcaccgacggtctggaggcgaccgcctcgcgcggcatgctccgcgccgtcggcatgggcgacgacgactgggagaagccccagatcggggtggcctccagctggaacgagatcaccccctgcaacctgtccctggaccgcctcgcgaaggccgtcaaggacggcgtgcactccgcccacggcttcccgatggagttcggcaccatctccgtctccgacggcatctcgatgggccacgaggggatgcactactccctcgtctcgcgcgaggtcatcgccgactccgtcgagaccgtcatgagcgccgagcgcctcgacgggtccgtcctgctcgccggctgcgacaagtccctgccggggatgctcatggccgccgcgcgcctggacctggccagcgtcttcctctacgccggcacgatcctgcccgggcgggccaagctgtccgacggcagcgagcacgaggtcaccctcatcgacgccttcgaggccgtcggggcgtgcgcgcgggggctgatgtcccgcgaggacgtcgacgtcatcgagcgcgccatctgccccggcgagggggcctgcgggggcatgtacaccgcgaacacgatggccgccgcggccgaggcgctggggatgtccctgcccggcagcgcggccccgcccgcgaccgaccgccgtcgcgacgggttcgcccgccgctccggcgaggccgtggtgaacctgctctcgaagggcatcaccgcccggcagatcctcaccaaggaggcgttcgagaacgccatcgccgtcgtcatggccctgggcggctccaccaacgccgtcctgcacctgctggccatcgcctacgaggccgaggtcgacctcaccctcgccgacttcgaccgcgtcgccgcgaaggtcccgcacctggccgacctcaagcccttcggccgccacgtcatggtcgacgtcgaccgcatcggcggcatccccgtcgtcatgcgcgcgctgctggacgcgggcctgctgcacggggactgcctgacggtgaccgggaggacgatggccgagaacctcgccgacatcgccccgcccgacgtcgacggcgtcgtgctgcgctcgctgcaggaccccatccacaagaccggcggcatcacgatcctctccggcaacctcgcccccggcggcgcggtggtgaagagcgcgggcttcgactccgacgtcttcgagggcaccgcgcgggtcttcgagcgcgagcgcgccgccctggacgccctggaggacggcacgatctccgccggcgacgtcgtcgtcatccgctacgagggccccaagggcggcccggggatgcgcgagatgctcgccatcaccggcgcgatcaagggcgcgggcctgggcaaggacgtgctgctcatgaccgacgggcgcttctccggcgggacgacgggcctgtgcgtggggcacgtggcccccgaggccgtcgacgccggtcccatcgcgttcgtgcgcgacggggaccggatccgcctggacgtcgccggcaagaccctcgaggtgctggtggacgaggaggagctcgccgcccgccgcgagggctgggagccgctgcccccggtcttcaagcgcggggtgctggccaagtacgccaagcaggtccagtccgcctcgctcggggccgtctgccgctga

SEQ ID NO: 22 - protein, 563 aa, Kineococcus radiotolerans
MSVDIKPRSRQVTDGLEATASRGMLRAVGMGDDDWEKPQIGVASSWNEITPCNLSLDRLAKAVKDGVHSAHGFPMEFGTISVSDGISMGHEGMHYSLVSREVIADSVETVMSAERLDGSVLLAGCDKSLPGMLMAAARLDLASVFLYAGTILPGRAKLSDGSEHEVTLIDAFEAVGACARGLMSREDVDVIERAICPGEGACGGMYTANTMAAAAEALGMSLPGSAAPPATDRRRDGFARRSGEAVVNLLSKGITARQILTKEAFENAIAVVMALGGSTNAVLHLLAIAYEAEVDLTLADFDRVAAKVPHLADLKPFGRHVMVDVDRIGGIPVVMRALLDAGLLHGDCLTVTGRTMAENLADIAPPDVDGVVLRSLQDPIHKTGGITILSGNLAPGGAVVKSAGFDSDVFEGTARVFERERAALDALEDGTISAGDVVVIRYEGPKGGPGMREMLAITGAIKGAGLGKDVLLMTDGRFSGGTTGLCVGHVAPEAVDAGPIAFVRDGDRIRLDVAGKTLEVLVDEEELAARREGWEPLPPVFKRGVLAKYAKQVQSASLGAVCR

SEQ ID NO: 23 - DNA, 1704 bp, Janibacter sp.
atgagcaagcccgacatcgacatcaagccccgtagccgcgacgtcaccgacggtctcgagaagaccgcggcccgaggaatgctccgtgccgtaggcatgggcgacgacgactgggtcaagccacagatcggtgtcgcgagctcctggaacgagatcaccccctgcaacctctctctcgaccgcctgtccaaggcagtcaaggacggcgtccacgctgccggtggctacccgctcgagttcggcacgatctcggtgtccgacggcatctcgatgggccacgagggcatgcacttctcgctcgtgtcgcgcgagatcatcgccgactccgtcgagaccgtcatgagtgccgagcgcctcgacggctcggtcctgctcgccggctgcgacaagtccctcccgggcatgctcatggctgcggcgcgcctcgacctcgcctcggtcttcctgtatgccgggtcgatccttcccgggatcgcgaagctctcggacggcaccgagaaggaggtcacgatcatcgacgccttcgaggccgtcggtgcagccaacgcgggcaagatgtcgctggccgacgtcgacgccatcgagcgcgcgatctgtccgggggagggcgcctgtggcggtttctacacggccaacaccatggctgcggtcgccgagtcgatcggcatgtccatcccgggttcggccgccccgccagccaccgaccgacgccgcgacgtgcacgcccgccgctccggtgaggccgtcgtcgagctcctgcgtcgcggcatcaccgcccgccagatcatgaccaagcccgcgttcgagaacgccatcgccgtcgtcatggccttcggtggctcgaccaacgccgtcctccacctgctcgccatggcccacgaggccgaggtcgacctcaccatcggcgacttccagcgcatcggcaaaaaggtcccgcacctcgccgacgtcaagccgttcggcgccttcgtcatgaaggacatcgaccacatcggtggcatccccgtcgtcatgaagtcgctgctcgaggccgacctcctcgatggcgacgcactcaccgtgaccggcaagaccgtcgccgagaacctcgacgagatcaagccgccgcacatcgacggtcgcgtgatccgcgagttcagcaacccgatccacaagaccgggggcctcaccatcctcaccggctccctcgcgcccgaaggtgcggtcgtgaagtcggccggattcgacaccgaggtcttcgagggcagcgcccgcgtcttcaacggcgagcgtgccgcgatggatgccgtcgagcagggtgccctcaagccccaggacgtcgtcgtcatccgctacgaagggcccaagggtggcccgggaatgcgcgagatgctcgccgtcaccggcgccatcaagggcgcgggtctcggcaaggacgtcctcctcctcaccgacggtcgcttctccggtggcacgaccggcctctgcgtcggacacgtggcccccgaggccgtcgacgagggccccatcgccttcgtccgtgacggagacggcatccgcctcgacgtcgcgaacggcactcttgacctcctcgtcgacgacgccgagctcgagcgccgccgcaccgagggcgtcacccatcccgagcccaagtacacccgcggcgtgctcgcgaagtaccgcaagctcgtcggctcggccagcaagggcgccgtctgcgactga

SEQ ID NO: 24 - protein, 567 aa, Janibacter sp.
MSKPDIDIKPRSRDVTDGLEKTAARGMLRAVGMGDDDWVKPQIGVASSWNEITPCNLSLDRLSKAVKDGVHAAGGYPLEFGTISVSDGISMGHEGMHFSLVSREIIADSVETVMSAERLDGSVLLAGCDKSLPGMLMAAARLDLASVFLYAGSILPGIAKLSDGTEKEVTIIDAFEAVGAANAGKMSLADVDAIERAICPGEGACGGFYTANTMAAVAESIGMSIPGSAAPPATDRRRDVHARRSGEAVVELLRRGITARQIMTKPAFENAIAVVMAFGGSTNAVLHLLAMAHEAEVDLTIGDFQRIGKKVPHLADVKPFGAFVMKDIDHIGGIPVVMKSLLEADLLDGDALTVTGKTVAENLDEIKPPHIDGRVIREFSNPIHKTGGLTILTGSLAPEGAVVKSAGFDTEVFEGSARVFNGERAAMDAVEQGALKPQDVVVIRYEGPKGGPGMREMLAVTGAIKGAGLGKDVLLLTDGRFSGGTTGLCVGHVAPEAVDEGPIAFVRDGDGIRLDVANGTLDLLVDDAELERRRTEGVTHPEPKYTRGVLAKYRKLVGSASKGAVCD

SEQ ID NO: 25 - DNA, 1704 bp, Nocardioides sp.
atgaccgagcccacctcccgccccgacatcaagccccgctcccgcgacgtcaccgacggcctggagaaggccgccgcgcgcggcatgctgcgggcggtaggcatgggcgacgaggacttcgcgaagccgcagatcggcgtgggctcgagctggaacgagatcaccccgtgcaacctgtccctggaccggctcgccaaggccgtgaagaacggcgtgcacgcggccggcggctacccgctggagttcggcaccatctcggtctccgacggcatctccatgggccacgagggcatgcacttctcgctggtctcccgcgaggtgatcgccgactcggtcgagaccgtgatgatggccgagcgcctggacggctcggtgctgctcgccggctgcgacaagtcgctgccgggcatgatgatggccgccgcccgcctcgacctggccagcgtgttcctctacgccggctcgacgatgcccgggcaggtggacggcaacgacgtcacgatcatcgacgcgttcgaggccgtcggggcgtgcctggccggcaagatcagccgcgacgaggtggaccggatcgagcgggccatctgtccgggcgagggcgcctgcggcggcatgtacaccgcgaacacgatggcctccatcgccgaggcgatcggcatgtcgctccccggctcggcggccccgccggcggtcgatcgccgacgcgacggcttcgcgcaccgctcgggggaggccgtggtcaacctgttgcgccagggcatcacggcccgccagatcatgactcgcgcggcgttcgagaacgcgatcacggtcgcgatggcgctcggcggctcgaccaacgccgtgctccacctgctcgcgatggctcgtgaggccgacgtcgacctcaccatcgacgacttcaaccggatcggtgacaaggtgccgcacctcggcgacctcaaaccgttcggcaagtacgtcatgaacgacgtcgacaagatcggcggcatccccgtcgtgatgaaggcactgctcgacgccggtctgatgcacggcgacgcgctcaccgtcaccggcaagaccctggccgagaacctcgccgagctggccccgccggagctcgatgacgaggtgatccgcaagctggaccggccgatccacaagaccggtgggctcacgatcctcaagggctcgctcgctcccgagggcgccgtggtcaagacggccggcttcgacgactccgtgttcaccggcaccgcccgcgtcttcgacggcgagcgggccgcgatggacgccctcgaggccgggcagatccagccccgcgacgtcgtggtgatccgctacgagggcccgaagggtggccccggcatgcgcgagatgctcgcgatcaccggcgcgatcaagggcgccggcctcggcaaggacgtcttgctgatcaccgacggcaggttctccggtggtacgacgggcctgtgcgtgggccacatcgcccccgaggccgtcgacggcggcccgatcgcgttcgtccgcgacggcgaccagatcaccctcgacgtcgccaaccggctgctcgaggtggaggtcgtcggtcccgatgccgaggccgagtgggagcgccgcaaggtcggctgggagccgaatccgcccaagtacacccgcggggtgctcggcaagtacgccaagatcgtccagtccgccgcgcacggcgccatcaccggctga

SEQ ID NO: 26 - protein, 567 aa, Nocardioides sp.
MTEPTSRPDIKPRSRDVTDGLEKAAARGMLRAVGMGDEDFAKPQIGVGSSWNEITPCNLSLDRLAKAVKNGVHAAGGYPLEFGTISVSDGISMGHEGMHFSLVSREVIADSVETVMMAERLDGSVLLAGCDKSLPGMMMAAARLDLASVFLYAGSTMPGQVDGNDVTIIDAFEAVGACLAGKISRDEVDRIERAICPGEGACGGMYTANTMASIAEAIGMSLPGSAAPPAVDRRRDGFAHRSGEAVVNLLRQGITARQIMTRAAFENAITVAMALGGSTNAVLHLLAMAREADVDLTIDDFNRIGDKVPHLGDLKPFGKYVMNDVDKIGGIPVVMKALLDAGLMHGDALTVTGKTLAENLAELAPPELDDEVIRKLDRPIHKTGGLTILKGSLAPEGAVVKTAGFDDSVFTGTARVFDGERAAMDALEAGQIQPRDVVVIRYEGPKGGPGMREMLAITGAIKGAGLGKDVLLITDGRFSGGTTGLCVGHIAPEAVDGGPIAFVRDGDQITLDVANRLLEVEVVGPDAEAEWERRKVGWEPNPPKYTRGVLGKYAKIVQSAAHGAITG

SEQ ID NO: 27 - DNA, 1722 bp, Renibacterium salmoninarum
atgagtgtggaaaccagtagcgaaaccggcaacaaaccagatatcaaaccgagaagccgcattgtcaccgacggaattgccgccgcgcctgctcgaggaatgctccgagccgttggctttggcgacgaggactttgcgaagccgcagattggcgtcgcgagttcgtggaacgaaattaccccctgcaatctctcccttgatcggctggccaaagccgtcaaagagggcgtgcatgccggcggcggcttcccgatgatctttggcacaatttcggtgtccgatggcatttcgatggggcacgaaggtatgcacttctcgcttgtctcccgcgaagtgattgctgactcggtagagactgttatgcaagcagaacgcatcgatggctcggtgctgcttgctggctgcgataagtcattgccgggcatgttgatggccgcagcccggctcaatgtgtccagtgttttcctctacgccggctcaatcatgcccggctgggtcaagcttgaagacggcacagagaaagacgtcacgcttattgacgcctttgaagctgtcggtgcctgcgcagccggcaaaatgtcggtgggggatctagaccgaatcgaacgggcaatttgtccgggcgaaggtgcctgcggtggtatgtacaccgcgaacactatggcctgtattggcgaggccttgggtatgtccttgcctggctcggctgcgccgccaagtgcggaccgccgtcgcgatatgttcgcgcaccgttctggcgaggctgttgttgagttgctccgccggggcattcgctcgcgcgacatcatgaccaaggaagcctttgagaacgcgattgcggtcacgatggcttttggcggctccacgaacgcagtgctgcacctacttgctattgctcgtgaggccgaggttgatctgcagcttgaggacttcaaccgaattggtgacaagatcccgcacctcggcgacctcaagccttttggccgatacgtgatgaacgacgtcgaccgggtgggcggcgtgccggtgataatgcgcgcgctgctcgatgccgggctactgcatggtgatgccttgaccgtgaccggtaagactctggccgaaaatcttgaagcgatcaatccgccagatctggatggcaagattttgcgtgcgttggataatccaatccacaaaactggtgggttgagtgtgctcaagggctcgcttgcacctggcggcgccgtggttaagaccgccgggttcgacgccgaggttttcgaaggcccggctcgggtttttgaacgcgaacaaggcgcactcgaagcgcttaaggctggcgaaatcaaagcgggcgacgtcgtcgtgatccgctatgaaggccctaaaggtgggccgggtatgcgcgaaatgctcgccatcactggcgcgatcaagggcgctggcctgggcaaagacgtgttgttgttgaccgacggtcggttctccggaggtacaacgggtctgtgcatcgggcacgtggcgccggaagctgtcgacgccgggccaatcgcctttgtgcaagacggcgacctaatccgggttgatatccccaacaagagtttcgatctcttggttgacgaagcagagctggaagctcggaaaatcggttgggagccgttgcctgctcgcttcactaaaggcgtgttggctaagtacgctaagcttgtgcactcggcttccgaaggcgcatactgcggctaa

SEQ ID NO: 28 - protein, 573 aa, Renibacterium salmoninarum
MSVETSSETGNKPDIKPRSRIVTDGIAAAPARGMLRAVGFGDEDFAKPQIGVASSWNEITPCNLSLDRLAKAVKEGVHAGGGFPMIFGTISVSDGISMGHEGMHFSLVSREVIADSVETVMQAERIDGSVLLAGCDKSLPGMLMAAARLNVSSVFLYAGSIMPGWVKLEDGTEKDVTLIDAFEAVGACAAGKMSVGDLDRIERAICPGEGACGGMYTANTMACIGEALGMSLPGSAAPPSADRRRDMFAHRSGEAVVELLRRGIRSRDIMTKEAFENAIAVTMAFGGSTNAVLHLLAIAREAEVDLQLEDFNRIGDKIPHLGDLKPFGRYVMNDVDRVGGVPVIMRALLDAGLLHGDALTVTGKTLAENLEAINPPDLDGKILRALDNPIHKTGGLSVLKGSLAPGGAVVKTAGFDAEVFEGPARVFEREQGALEALKAGEIKAGDVVVIRYEGPKGGPGMREMLAITGAIKGAGLGKDVLLLTDGRFSGGTTGLCIGHVAPEAVDAGPIAFVQDGDLIRVDIPNKSFDLLVDEAELEARKIGWEPLPARFTKGVLAKYAKLVHSASEGAYCG

SEQ ID NO: 29 - DNA, 1767 bp, Arthrobacter aurescens
gtgcaacagcgtcggcagtcgcccggtagacatagactttggaccatgagtgacaccacccagattgcgacagacagcacgccggacattaaaccccgcagccgggtggtgacagacggcattcacgcggcgcctgcccgcggcatgttccgtgcggtgggcatgggcgacgacgactttgccaaaccccaaatcggtgttgccagctcgtggaatgaaattaccccttgcaatctttccctgaatcgcctcgcacaaggcgccaaggaaggcgtccatgccggcggcggcttcccgatgcagttcggcacgatctccgtttcggatggtatttccatgggccacgagggcatgcacttctccctggtctcccgcgaagtcatcgccgactctgtggaaacagtgatgcaggccgagcgcattgacggctcggtgctcctggccggctgtgacaagtcccttccgggcatgctcatggctgctgcccgcttggacctcgcatccgtcttcctctacgccggctccatcatgccgggctgggtcaagctggaggacggctcggagaaggaagtcaccctcattgatgccttcgaggccgtgggtgcctgcgccgccggcaaaatgagcatggaagacctcacaaggatcgaaaaggccatctgtcccggcgaaggcgcctgcggcggtatgtacacggccaacaccatggcgtgcatcggcgaggccttgggcatgtccctcccgggttcagccgccccgccgtcggcagaccgccgtcgtgatgatttcgcacgcaagtccggcgaagccgtagtaaacctgctgcgcctgggcatcacggcccgcgacatcatgaccaaaaaggcgttcgagaatgccattgccgtcaccatggccttcggcggttccaccaacgccgtgctgcacttgctcgcgatcgcccgggaagccgaagtagagctgacgctggacgacttcaatcgcatcggcgacaaaattccgcaccttggggacctcaagcccttcggccgttatgtgatgaccgacgttgacaagatcggcggcgtgccggtcatcatgaaggcactgctcgacgccggactactgcacggcgactgcctcaccgttaccggcaagacgctcgcggaaaacctcgcctcgatcaacccgccggaccttgacggcaaaatcctccgtgcgctggacaacccgatccacaagaccggtggcatcaccatcctccacggctctatggctccggaaggagcggtagtgaagagtgccggttttgatgctgacgtctttgaaggaactgcacgcgttttcgaacgcgagcagggcgccctcagcgcgttggacaacggcgaaatcaacaagggagacgtagtggtcatccgctatgaaggccccaagggcggtcccggcatgcgggaaatgttggccatcaccggcgccatcaagggagcgggactcggcaaggatgtcctccttctcacggatggccggttctcgggtggcacaacgggtctgtgcatcggccacgttgcgcctgaagccgtggatggtggccccatcgcgttcgtgaaggacggtgaccgcatccgtgtagacatcgccgctcgctccttcgacctcctggtggacgaagccgagctcgaagcccgcaaagagggctggaagccactgcccgccaagttcaccaagggtgttcttgccaagtacgccaagcttgtccacagcgcctccaccggagcgtactgcggataa

SEQ ID NO: 30 - protein, 588 aa, Arthrobacter aurescens
MQQRRQSPGRHRLWTMSDTTQIATDSTPDIKPRSRVVTDGIHAAPARGMFRAVGMGDDDFAKPQIGVASSWNEITPCNLSLNRLAQGAKEGVHAGGGFPMQFGTISVSDGISMGHEGMHFSLVSREVIADSVETVMQAERIDGSVLLAGCDKSLPGMLMAAARLDLASVFLYAGSIMPGWVKLEDGSEKEVTLIDAFEAVGACAAGKMSMEDLTRIEKAICPGEGACGGMYTANTMACIGEALGMSLPGSAAPPSADRRRDDFARKSGEAVVNLLRLGITARDIMTKKAFENAIAVTMAFGGSTNAVLHLLAIAREAEVELTLDDFNRIGDKIPHLGDLKPFGRYVMTDVDKIGGVPVIMKALLDAGLLHGDCLTVTGKTLAENLASINPPDLDGKILRALDNPIHKTGGITILHGSMAPEGAVVKSAGFDADVFEGTARVFEREQGALSALDNGEINKGDVVVIRYEGPKGGPGMREMLAITGAIKGAGLGKDVLLLTDGRFSGGTTGLCIGHVAPEAVDGGPIAFVKDGDRIRVDIAARSFDLLVDEAELEARKEGWKPLPAKFTKGVLAKYAKLVHSASTGAYCG

SEQ ID NO: 31 - DNA, 1695 bp, Leifsonia xyli
atgcctcagatcgattggaaaccgcgttcgcgcgttgtcacggacgggatcgaagccaccacgagccgcgggatgctccgtgcggtcggcatgggggacgccgactgggagaagccgcagatcggcatcgcctcgtcctggaacgagatcacgccgtgcaacctctcgctcgaccggctggcccagggcgccaaagaaggcgtccactccggtggcggttatccgctgcaattcggtaccgtctcggtctccgacggtatctcgatggggcacgagggaatgcacttctcgctcgtctcccgtgaggtcatcgccgactcggtcgagacggtcatgatggccgagcggctcgacggcaccgtcctcctcgccggctgcgacaaatcgctgccgggcatgctgatggccgcggcccgtctcgacctctccgcgatcttcctctacgcgggctccatcgcgcccggctgggtcaaactcagcgacggcaccgagaaggacgtcacgatcatcgactcgttcgaggctgtcggtgcgtgcaaggccggcaagatgagcgaggaggacctcaaacgcatcgagtgcgccatagccccgggtgaaggagcctgcggcggcatgtacaccgcgaacaccatggcgtccgtcgccgaggcactcgggatgagcctgcccggctcggctgcgccgccctcggccgaccggcggcgcgactccttcgcccaccgctccggcgaggctgttgtctccctgctgaagcagggcatcacggctcgcgacatcctcaccaagaaggcgttcgagaacgccatcgcggtggcgatggccttcggcgggtcgacgaacgtcgtgcttcacctgctcgccatcgcgcgcgaggccgaggttgacctcaccatcgacgatttcaaccgcatcggcgagacggttccgcacatcggcgatctcaaaccgttcggcacgtacgtcatgaacgacgtcgaccgtcacggtggtgtcccggtcgtcatgaaggcgctcctggacgcgggcctgctgcacggggactgcctcaccgtgaccggcaagaccgtcgcggagaacctggcggagatcgacccgcccgcaccggacggcaccgtcctgcgctcgctggacaaccccatccacccgacaggggggctcacaatcctcaagggcacgctcgctccggagggcgccgttgtcaagacggctggtttcgacgccgaggtgttcgagggcccagcgcgcgtgttcgagcgcgagcgcgccgctatggacgctctcaccgcgggccggatcaacgccggcgatgtggtcgtcatctgctacgaagggccgaagggcggtcccgggatgcgcgagatgctcgcgatcaccgccaccatcaagggtgcaggcctcggcaaggatgtactactcttgacggacgggcgattctcaggcggcacaaccggcctgtgcatcggccacatagcacccgaagcggtggacgctggtcccatcgcattcgtgcgcgatggtgatttgatacgggtcgatatcgcggctcgctccctcgacctactggtcgacgagtcagagctgaccgcccgccgggacggctgggcgcctcttcctccgcgctatacccgtggcgttctcgcgaagtactccaagctcgttcgctccgctgcggagggtgcggtcaccgggtag

SEQ ID NO: 32 - protein, 564 aa, Leifsonia xyli
MPQIDWKPRSRVVTDGIEATTSRGMLRAVGMGDADWEKPQIGIASSWNEITPCNLSLDRLAQGAKEGVHSGGGYPLQFGTVSVSDGISMGHEGMHFSLVSREVIADSVETVMMAERLDGTVLLAGCDKSLPGMLMAAARLDLSAIFLYAGSIAPGWVKLSDGTEKDVTIIDSFEAVGACKAGKMSEEDLKRIECAIAPGEGACGGMYTANTMASVAEALGMSLPGSAAPPSADRRRDSFAHRSGEAVVSLLKQGITARDILTKKAFENAIAVAMAFGGSTNVVLHLLAIAREAEVDLTIDDFNRIGETVPHIGDLKPFGTYVMNDVDRHGGVPVVMKALLDAGLLHGDCLTVTGKTVAENLAEIDPPAPDGTVLRSLDNPIHPTGGLTILKGTLAPEGAVVKTAGFDAEVFEGPARVFERERAAMDALTAGRINAGDVVVICYEGPKGGPGMREMLAITATIKGAGLGKDVLLLTDGRFSGGTTGLCIGHIAPEAVDAGPIAFVRDGDLIRVDIAARSLDLLVDESELTARRDGWAPLPPRYTRGVLAKYSKLVRSAAEGAVTG

SEQ ID NO: 33 - DNA, 1704 bp, Marine actinobacterium
atgtctgagagtgattcgattgatatcaagccacgttcccgcacggtaaccgacggaattgaagcaacaacttcgcgcggaatgctgcgtgcagttggtatgggagatgccgactgggagaagccccagatcggtattgcgagctcgtggaacgagatcaccccctgcaatctgtcgctcgatcgcctcgctcaagcggcgaaagagggagtgcacgccggtggcgggtacccactgcagtttggaacgattagcgtttccgatggcatttcaatggggcacgaggggatgcacttctcactcgtgagtcgcgaagttatcgctgactccgttgaggttgtcatggaggcagagcgcctcgacggttcggtcacgctcgcgggctgcgacaagtcgcttcccggaatgctgatggctgcggcgcggctcaacctcgcctctgtcttcctctatgccggttcgatcgctcccggctgggtcaagctcagcgacggtaccgaaaaagacatcacgatcatcgactcgttcgaagcagtcggcgcagtcaaagctggccggatgagcgaagccgacgccaagcgcatcgagtgtgcttttgcgcccggcgagggtgcctgtggcggtatgtacacggccaacacgatggcgagcgttgcggaagccctgggaatgagtcttcccggctcggcgagcccagcatccgccgatcgtcgtcgcgactacttcgcgcaccgttcaggcgaagctgtcgtcaatcttctgcgcctcggtatcacttcgcgcgacatcatgacgaagaaggcttttgagaacgcgatcacggtagcaatggctcttggtggctccacgaacgttgtgctgcacatcctcgccatcgcgagcgaagccgaagttgaactcacgctcgatgacttcaatcgcatcggcgacaaggttccccacttgggcgacctgaagccgttcggccagtacgtcatgaacgatgttgaccgccacggcgggctcccggtgctcatgaaggcgctcatggaggaggggctcattcacggcgatgccctcacagtgacgggcaagactgttgccgaaaacttggccgagatggacatcgatcctctagatggcaaggttcttcgcaagttcgacaaccccatccaccccactgggggtctcacaattcttaagggttctttcgctcccgagggtgcagtcgtgaagacggcaggtttcgacgttgctgagttcgtgggccctgcccgcgtgttcgagcgcgagcgtgaagcactggatgctttgactgccggcacgatcgaggctggttctgttgtcgtcattcgctatgaaggacccaagggtggaccgggcatgcgcgagatgctcgcgatcacggcggccatcaagggcgctggactcggcaaagatgtactactcttaacagacggacgattctcaggcggcacaaccggactgtgtatcggccacatagctcccgaagcagtagacgcaggtcctattgccttcgtgcgcgatggtgatcttatacgggtcgatatcgcagctcgctcgctcgacttacttgtcgactccgctgagctcgaagcccgccgaaaaggctgggcccccctccctccgcgctacacgcgaggtgttctggccaagtattcgaagcttgttcagtccgccgctcgcggcgcggtcaccagttag

SEQ ID NO: 34 - protein, 567 aa, Marine actinobacterium
MSESDSIDIKPRSRTVTDGIEATTSRGMLRAVGMGDADWEKPQIGIASSWNEITPCNLSLDRLAQAAKEGVHAGGGYPLQFGTISVSDGISMGHEGMHFSLVSREVIADSVEVVMEAERLDGSVTLAGCDKSLPGMLMAAARLNLASVFLYAGSIAPGWVKLSDGTEKDITIIDSFEAVGAVKAGRMSEADAKRIECAFAPGEGACGGMYTANTMASVAEALGMSLPGSASPASADRRRDYFAHRSGEAVVNLLRLGITSRDIMTKKAFENAITVAMALGGSTNVVLHILAIASEAEVELTLDDFNRIGDKVPHLGDLKPFGQYVMNDVDRHGGLPVLMKALMEEGLIHGDALTVTGKTVAENLAEMDIDPLDGKVLRKFDNPIHPTGGLTILKGSFAPEGAVVKTAGFDVAEFVGPARVFEREREALDALTAGTIEAGSVVVIRYEGPKGGPGMREMLAITAAIKGAGLGKDVLLLTDGRFSGGTTGLCIGHIAPEAVDAGPIAFVRDGDLIRVDIAARSLDLLVDSAELEARRKGWAPLPPRYTRGVLAKYSKLVQSAARGAVTS

SEQ ID NO: 35 - DNA, 1695 bp, Clavibacter michiganensis
atgcctgagatcgacatgaagccccggagccgcgacgtcaccgacgggatcgaggccaccgcagcacgcggcatgctccgcgccgtcgggatgggcgacgaggactgggcgaagccccagatcggcgtcgcgagctcctggagcgagatcaccccctgcaacctcagcctcgaccgcctcgcgcagggcgccaaggagggcgtgcacgcgggcggcggctacccgctccagttcggcaccatctccgtcagcgacggcatctcgatgggccacgagggcatgcacttctcgctcgtctcgcgcgaggtcatcgccgacagcgtcgagaccgtcatgatggccgagcgcctcgacgggtccgtgctcctcgcgggctgcgacaagtcgctccccggcatgctcatggccgcggcccgcctcgacctctcctcggtgttcctctacgcgggatccatcgcccccggctgggtcaagctctcggacggcaccgagaaggaggtcaccatcatcgacgccttcgaggcggtcggcgcctgcaaggccggcacgatgagccaggaggacctgacccgcatcgagaaggccatctgcccgggcgagggcgcatgcggcggcatgtacacagcgaacaccatggcgagcgtggccgaggccctcggcatgagcctccccggatccgccgccccgccgagcgccgaccgccgccgcgactacttcgcgcaccggtcgggcgaggccgtcgtcaacctcatcgcggagggcatcaccgcgcgcgacatcatgacgaaggaggcgttcgagaacgccatctccgtggtcatggcgttcggcggatccaccaacgcggtcctccacctcctcgccatcgcgcgcgaggccgaggtcgacctgcagctgtccgacttcaaccgcatcgccgaccgcgtgccgcacctcggcgacctcaagccgttcggccgcttcgtcatgaacgacgttgaccgcgtcggcggcgtccccgtcgtcatgaaggccctgctcgacgcgggcctcctgcacggcgacgtcatgaccgtcaccggccgcaccatgcgcgagaacctcgaggcgatggacctcgcggagctcgacggcacggtcatccggaagatggacgacccgatccacgccaccggcggcatcagcgtcctgcacggctccctcgcccccgagggcgcggtcgtgaagacggccggcttcgacctcgacgtgttcgagggccccgcccgcgtcttcgagcgcgagcgcgccgcgatggacgcgctcaccgagggactcatctcgaagggcgacgtcatcgtcatccgctacgagggccccaagggcggccccggcatgcgcgagatgctcgccatcacgggcgccatcaagggagccggcctcggcaaggatgtactactcttgacggacggtcgattctcaggcggcacaaccggactgtgcatcggccacatggctcccgaagcggtggacgcaggtcccgtcgccttcgtgcgcgatggagaccggatccgtgtcgacatcgccgctcgcacgctcgacctactggtcgacgaggccgagctcgccgcccgccgtgaggggtgggcacctctcccgccgcgctacacgcgcggggtcctcgccaagtacgccaagctcgtgcactcggccgccgagggcgcgatcacgggatga

SEQ ID NO: 36 - protein, 564 aa, Clavibacter michiganensis
MPEIDMKPRSRDVTDGIEATAARGMLRAVGMGDEDWAKPQIGVASSWSEITPCNLSLDRLAQGAKEGVHAGGGYPLQFGTISVSDGISMGHEGMHFSLVSREVIADSVETVMMAERLDGSVLLAGCDKSLPGMLMAAARLDLSSVFLYAGSIAPGWVKLSDGTEKEVTIIDAFEAVGACKAGTMSQEDLTRIEKAICPGEGACGGMYTANTMASVAEALGMSLPGSAAPPSADRRRDYFAHRSGEAVVNLIAEGITARDIMTKEAFENAISVVMAFGGSTNAVLHLLAIAREAEVDLQLSDFNRIADRVPHLGDLKPFGRFVMNDVDRVGGVPVVMKALLDAGLLHGDVMTVTGRTMRENLEAMDLAELDGTVIRKMDDPIHATGGISVLHGSLAPEGAVVKTAGFDLDVFEGPARVFERERAAMDALTEGLISKGDVIVIRYEGPKGGPGMREMLAITGAIKGAGLGKDVLLLTDGRFSGGTTGLCIGHMAPEAVDAGPVAFVRDGDRIRVDIAARTLDLLVDEAELAARREGWAPLPPRYTRGVLAKYAKLVHSAAEGAITG

SEQ ID NO: 37 - DNA, 1707 bp, Saccharopolyspora erythraea
gtgagcaccagcactgatggcacaggacagtcggggcgtggtctgaagccccgcagcggtgacgtgaccgaggggatcgaacgtgctgcggcgcgggggatgctccgggcggtcgggatgcaggacgccgacttcgcgaagccccagatcggggtggcgtcctcgtggaacgagatcacgccgtgcaacctgtcgttgcagcggctcgcgcaggcgagcaaggaaggtgtgcacgcggccggcggcttcccgatggagttcgggacgatctcggtctcggacgggatctcgatgggtcacgtcggcatgcactactcgctcgtgtcccgcgaggtcatcgccgactccgtcgagacggtgatggaggcggagcggctcgacgggtccgtgctgctcgccggctgcgacaagagcctgccgggcatgctgatggccgcggcgcgcctggacgtcgcggcggtcttcgtctacgccgggtcgatcctccccgggcgggtcgacgaccgcgaggtcaccatcatcgacgcgttcgaggcggtgggcgcctgcgcccgcggcctgatcagcgaggccgaggtcgaccgcatcgaacgcgccatctgcccgggagagggcgcgtgcggcggcatgtacaccgcgaacaccatggcctgcgcggcagaggcgatgggcatgtcgctgccgggatcggcgagcccgccgtcggtagaccggcggcgcgacgccggagcccgggaggccgggcgcgcggtggtcgggatgatcgagcgcggactgaccgcgcggcagatcctgaccaaggaggcgttcgagaacgccatcgccgttgtgatggcgttcggtggctccaccaatgccgtgctgcacctgttggcgatcgcgcgggaagccgaggtcgacctgacgctcgacgacttcaaccgcatcggtgaccgcgtcccgcacctcgccgacgtcaagcccttcggtcggcacgtgatgaccgcggtggaccggatcggtggcgtgccggtcgtgatgaaggccctgctcgacgccgggttgctgcacggcgactgcatgacggtcaccgggaagacggtggccgagaacctcgccgagctggatccgccggagctcgacggtgaggtcctgcacaagctgtcgaacccgctgcacccgaccggcgggctgacgattctgcgcggatcgctcgccccggaaggtgcggtggtcaagagcgccgggttcgactccgccactttcgaaggcacggcgcgggttttcgacggcgagcagggtgcgatggacgccgtcgaagacggctcgttgaaggccggcgacgtggtggtgatccggtacgaagggccgcgcggtggtccgggtatgcgcgagatgctcgcggtcaccggtgccatcaagggcgcgggcctgggcaaggacgtcctgctgctgacggacggccgtttctccggcggtaccacggggctgtgcatcggtcacgtggctcccgaggcgaccgacggcgggccgatcgcgttcgtgcgcgacggggacccgatccggctcgacctggcgggccggacgctcgacctgctggtggacgaagccgaactcgcgcgccggaaggaaggctgggtgccgcgggagccgaagttccggcagggcgtgctcgggaagtacgcgcggctggtccggtcggcggcggtgggcgcggtctgctcctga

SEQ ID NO: 38 - protein, 568 aa, Saccharopolyspora erythraea
MSTSTDGTGQSGRGLKPRSGDVTEGIERAAARGMLRAVGMQDADFAKPQIGVASSWNEITPCNLSLQRLAQASKEGVHAAGGFPMEFGTISVSDGISMGHVGMHYSLVSREVIADSVETVMEAERLDGSVLLAGCDKSLPGMLMAAARLDVAAVFVYAGSILPGRVDDREVTIIDAFEAVGACARGLISEAEVDRIERAICPGEGACGGMYTANTMACAAEAMGMSLPGSASPPSVDRRRDAGAREAGRAVVGMIERGLTARQILTKEAFENAIAVVMAFGGSTNAVLHLLAIAREAEVDLTLDDFNRIGDRVPHLADVKPFGRHVMTAVDRIGGVPVVMKALLDAGLLHGDCMTVTGKTVAENLAELDPPELDGEVLHKLSNPLHPTGGLTILRGSLAPEGAVVKSAGFDSATFEGTARVFDGEQGAMDAVEDGSLKAGDVVVIRYEGPRGGPGMREMLAVTGAIKGAGLGKDVLLLTDGRFSGGTTGLCIGHVAPEATDGGPIAFVRDGDPIRLDLAGRTLDLLVDEAELARRKEGWVPREPKFRQGVLGKYARLVRSAAVGAVCS

SEQ ID NO: 39 - DNA, 1677 bp, Acidothermus cellulolyticus
atgcgcgctcagcccgatctcaaaccgcgcagccgtgacgtcaccgatgggctggagcgggccgcggcccgcggcatgctccgcgccgtcggaatgaccgatgcggactgggagaaaccccagatcggagtggcgagttcctggaacgagataacgccctgcaacctctccctcgaccggctcgcgcaggcggccaaggagggcgtgcacgccgccggcgggtatccgctggagttcgccaccatctcggtttccgacggcatctccatgggccatgagggaatgcatttctcgctgatttcccgcgaagtcatcgccgattccgtcgaaaccgtcttcatggctgagcgcttcgacggcgccgtcctgcttgccggttgcgacaagtccgaacccggcatgctgatggcggccgcccggcttgacctggcagcggttttcctctatgccggcagcacgttgccggggaaactcggggaccgggacatcaacatcgtcgatgcgttcgaggctgtcggcggttgccttcgcggcctggtgagccgggaagaggtcgacgccatcgaacggaatttctgtccggtcgaaggggcctgcgcgggcatgttcaccgccaacacgatggccagcgcggcggaagcgctcggcatgtcattgcccggttcggcctcgccgcccgcgccggaccgccggcgcgacggtttcgcccgggcctccggggaggcagtcgtcaacctgctccgccgcggcatcaccgcccgggacatcatgacccgggaggcattcgagaacgcgatcgctgtcgtgatggccctgggcggctccaccaacgccgtgctccatctgctcgcgatcgcccgcgaggcgaacgtcgacctcgccatcgacgatttcaaccggatcggggaccgggtcccgcacttggcggatgtcaagccgttcggccggtacgtgatgagtgacgtcgaccgggtcggcggcgtgcccgtggtgatgaaagcgctgctggacgccgggctgctgcacggcgactgcctgacggtgaccggcaagacggtggcggagaacctcgcggacatcaccccgccggaccccgacggcaaggtgattcacgcgctcacccaaccgatccaccgcaccggcgggctggccattctccgcggttcgctcgccccggacggcgcggtggtgaagaccgccgggctggagtcgacgttcttcgaaggcaccgcccgggtgttcgacggcgaggaggcggccatgcgcgccgtgcccgagctgcgtccgggagatgtcgttgtcatccggtacgaggggccgaaaggcggcccagggatgcgggagatgctcgcggtcaccggcgccatcaagggcgcgggcctcggcaaggatgtgctcctcgtcaccgacggccggttctccggcggtaccacgggtttctgtgtcgctcacgttgctccggaggcggtggacgggggaccgatcgcgttcgtccgggacggtgaccgcatccggctggacgcgcaggcccgtaccctcgacctgctggtggacgccgatgagctggccaaacgacgggccgactggcaaccgccgccgccgcggtacaccaccggagtcgcggccaagtacgtcaagctggttggcagcgcctccgagggtgcgatctgtcggtga

SEQ ID NO: 40 - protein, 558 aa, Acidothermus cellulolyticus
MRAQPDLKPRSRDVTDGLERAAARGMLRAVGMTDADWEKPQIGVASSWNEITPCNLSLDRLAQAAKEGVHAAGGYPLEFATISVSDGISMGHEGMHFSLISREVIADSVETVFMAERFDGAVLLAGCDKSEPGMLMAAARLDLAAVFLYAGSTLPGKLGDRDINIVDAFEAVGGCLRGLVSREEVDAIERNFCPVEGACAGMFTANTMASAAEALGMSLPGSASPPAPDRRRDGFARASGEAVVNLLRRGITARDIMTREAFENAIAVVMALGGSTNAVLHLLAIAREANVDLAIDDFNRIGDRVPHLADVKPFGRYVMSDVDRVGGVPVVMKALLDAGLLHGDCLTVTGKTVAENLADITPPDPDGKVIHALTQPIHRTGGLAILRGSLAPDGAVVKTAGLESTFFEGTARVFDGEEAAMRAVPELRPGDVVVIRYEGPKGGPGMREMLAVTGAIKGAGLGKDVLLVTDGRFSGGTTGFCVAHVAPEAVDGGPIAFVRDGDRIRLDAQARTLDLLVDADELAKRRADWQPPPPRYTTGVAAKYVKLVGSASEGAICR

SEQ ID NO: 41 - DNA, 1704 bp, Corynebacterium efficiens
atgaccaacgatcatgacatcgatatcaagccacgttcacgcgatgtgaccgacggcctggaacgcaccgccgcccggggcatgctccgggcagtcggcatgggcgacgacgactgggagaaaccccagatcggtgtggccagctcctggaatgaaatcaccccctgtaatctcacgctgaagaagcttgctggatttgccaaggagggtgtccacgaggcggggggttaccccctggagttcgggaccatctccgtctccgacggtatctccatgggccacgagggcatgcactattccctggtatcccgcgaggtcatcaccgactccgtggaaaccgtcatgagtgccgagcgactggacggttctgttctactcgccggctgtgacaaatccattcccggcatgctcatggccgccgcccggttgaatctgtcctcggtgttcctctacaacggatccaccatgccgggcaccgcgaagatgtccgacggtacggagcgggaggtcaccctcatcgatgccttcgaggccgtcggagcctgtcgtgcgggaaccatgagccgggaggacgtggatgccattgaacgctccgtgtgccccggggagggtgcctgtggcggcatgtacacagccaacaccatggcctcggctgctgaggccatgggcatgtccctgcccggttccgccgctcccccggcgatccaccaggaccgcaccctctatgcccgccgttccggcgaggcggtggtggaactgctgcgcaggggaatccgtgcccgtgacatcatcacacgggaatcactgctcaatgccgtcgccgtggtcatggcgctgggtggctccaccaacgcggttctgcacctcatggccatcgcccacgaggccgaggtggatctcaccttggaggacttcaacgccgtcggcgacaaggtcccccaccttggtgacctcaaacccttcggccggtatgtgatgaacgacgtattcaagatcggcggcatccccgtggtgatgaaagcgcttctcgacgccggcctcatcaacggcgactgcctcaccatcaccggccggaccgttgcggagaacctccagggcatcaacccaccggatcccgacggccagatcctacgggccattgacaacccgatccacaagaccggtgggctgaccatcctgcacggttccctcgcaccgggtggtgccgtggtcaaaaccgctggtttcgacaccgaacgcttcgagggcaccgcccgtgtcttcaaccaggaagcacccgccatggatgcggtgctcaacggtgaactgaaggctggcgacgtggtgatcatccgctacgagggaccgaagggcggccccggcatgcgcgagatgctcgccatcaccggtgccatcaagggtgccggcatcggcaaggaggtgctgctcatcaccgacggtcgtttctccggtgggtccaccggcctgtgcatcgggcatgtggcccccgaggccgtcgacggcggacctatcgccctcgttgaagacggcgatcccatcctggtcgacatcagccaacgacgtatcgatctcctggtagacgaatccattctggaggagcgcaggaaaaccctgcagcatccggagaatccacgtctccacggcgtgctggggaagtacgccaagctggtgcagtcagcctcaatgggcgcggtctgcttctag

SEQ ID NO: 42 - protein, 567 aa, Corynebacterium efficiens
MTNDHDIDIKPRSRDVTDGLERTAARGMLRAVGMGDDDWEKPQIGVASSWNEITPCNLTLKKLAGFAKEGVHEAGGYPLEFGTISVSDGISMGHEGMHYSLVSREVITDSVETVMSAERLDGSVLLAGCDKSIPGMLMAAARLNLSSVFLYNGSTMPGTAKMSDGTEREVTLIDAFEAVGACRAGTMSREDVDAIERSVCPGEGACGGMYTANTMASAAEAMGMSLPGSAAPPAIHQDRTLYARRSGEAVVELLRRGIRARDIITRESLLNAVAVVMALGGSTNAVLHLMAIAHEAEVDLTLEDFNAVGDKVPHLGDLKPFGRYVMNDVFKIGGIPVVMKALLDAGLINGDCLTITGRTVAENLQGINPPDPDGQILRAIDNPIHKTGGLTILHGSLAPGGAVVKTAGFDTERFEGTARVFNQEAPAMDAVLNGELKAGDVVIIRYEGPKGGPGMREMLAITGAIKGAGIGKEVLLITDGRFSGGSTGLCIGHVAPEAVDGGPIALVEDGDPILVDISQRRIDLLVDESILEERRKTLQHPENPRLHGVLGKYAKLVQSASMGAVCF

SEQ ID NO: 43 - DNA, 1713 bp, Brevibacterium linens
atgagcattgatacgaactccaccaaaccggacatcaaaccacgttctcgcgacgtcaccgacggtctcgaagccaccgctgcgcgcggcatgctgcgtgccgtgggaatgggcgatgacgactgggtcaagccgcagatcgccatcgcgacctcgtggaacgagatcaccccgtgcaacatgtccctgcagcgcctcggtgcggccgccaaggaaggcgtgcacgaatcgggcggattccccctggaattcggcaccatctccgtctccgacggcatctccatgggccacgagggcatgcactactcgctggtctcgcgcgaggtcatcaccgactccgttgagaccgtgatgagcgccgaacgactcgacggatcggtcctcatggccggctgcgacaagtcgatcccgggcatgctcatggcatccgcccgcctcggcctctccagcgtattcctctacaacggctcgatcatgccgggtaccgcgaagatggaggacggcaccgagaaggaagtcaccctcatcgacgccttcgaagcagtcggcgcctgccgtgccggaaccatcagccaaaaagacgtcgactccatcgagcgcgccgtctgcccgggtgaaggcgcctgtggtggcatgtacaccgcgaatacgatggcctcggccgccgaggccatgggcatgtccctgccaggctcggccgcacctcctgccatccaccgcgaccgcacgatgttcgcgcgcaaatccggtgatgctgtcgtcaacctgctgcgtcagggaatcacgacgaaggacatcatcacccgcgaatcgctgcacaacgcgatcgccgtggtcatggccttcggcggatcgaccaacgcggttctccacctcctggccatcgcccacgaggccggagtcgaactcgccctcgatgacttcaaccgcatcggcgacaaggtcccgcacctgggcaacgtcaaacccttcggccagtacgtgatgaacgatgtgttcaagatcggcggcgtgccggtgatcatgaaggctctgctcgacaacggaatgctcaacggcgactgcatgaccgtgacgggaaagaccgtggcggagaacctcgagacgatcaacccgccggaccccgacggcaagatcctgcgcgcgctcaacaacccgattcacgccaccggcggcctcaccgtgctcaagggctcgttggctcccgaaggtgcagtcgtgaagtccgccggcttcgatgccgacgtcttcgaaggcaccgctcgcgtgttcaaccaggagaagccggccatggatgccgtcctcaacggtgagctgaagaagggcgatgtcgtcgtcatccgctacgaaggacccaagggcggacccggtatgcgcgagatgctcgccatcaccggtgcgatcaagggcgcgggaatcggcaaggacgtcctgctcatcaccgacggacgcttctccggcggatcgacgggactgtgcatcggtcacgtggcgcccgaggccgtcgacggcggaccgatcgcactcgtcgaggacggcgacaagatcaccgtcgacatcgcggcacggtccatcgacctgcatgttgacgagtcggtgctcgaagagcgtcgcaagacctggacgattcccgagaaccaccgcctcaccggtgtgctcggaaagtacgcgaagctcgtgcagtcggcctccaccggtgccgtctgcttctga

SEQ ID NO: 44 - protein, 570 aa, Brevibacterium linens
MSIDTNSTKPDIKPRSRDVTDGLEATAARGMLRAVGMGDDDWVKPQIAIATSWNEITPCNMSLQRLGAAAKEGVHESGGFPLEFGTISVSDGISMGHEGMHYSLVSREVITDSVETVMSAERLDGSVLMAGCDKSIPGMLMASARLGLSSVFLYNGSIMPGTAKMEDGTEKEVTLIDAFEAVGACRAGTISQKDVDSIERAVCPGEGACGGMYTANTMASAAEAMGMSLPGSAAPPAIHRDRTMFARKSGDAVVNLLRQGITTKDIITRESLHNAIAVVMAFGGSTNAVLHLLAIAHEAGVELALDDFNRIGDKVPHLGNVKPFGQYVMNDVFKIGGVPVIMKALLDNGMLNGDCMTVTGKTVAENLETINPPDPDGKILRALNNPIHATGGLTVLKGSLAPEGAVVKSAGFDADVFEGTARVFNQEKPAMDAVLNGELKKGDVVVIRYEGPKGGPGMREMLAITGAIKGAGIGKDVLLITDGRFSGGSTGLCIGHVAPEAVDGGPIALVEDGDKITVDIAARSIDLHVDESVLEERRKTWTIPENHRLTGVLGKYAKLVQSASTGAVCF

SEQ ID NO: 45 - DNA, 1710 bp, Tropheryma whipplei
gtgtttatgtcgagcgatgcaaatgcctgtgaaatagatataaagccgagaagccgagtcgtaacccatgggatcgaggcgacaacatcgcgtggtatgctgcgcgccgttggaatgggtgatgctgattgggaaaaaccacagattggcattgcatccagttggaataacataactccgtgcaatttgtcacttgacagacttgcgcagggtgcaagggaaggtgttcacgcagccggtgggtatccgctgcagttttgcactatatcggtttccgacggaatctctatgggtcatgagggaatgcatttttctcttgtttctcgcgaagttattaccgacagcgtggaaaccgttctgatggcagaggcactggatggtgttgttcttcttgctggctgtgataaatccctcccgggtatgcttatggcagctgcaaggcttgatgtgtctgcagtatttctatatgccggcagtattgcccccggttatgtcacactcaagtgtggcgagtcaaaagaagttacaataattgattcattcgaagccgttggtgcctataaggcagggcttattgatcaggatgatcttggccggattgaaagggccatatgccccggggagggcgcatgtggcggcatgtatacggcaaacacaatggcatctgttgcagaagcgcttggtatgagtcttttgggttcggcaagtccaccctcggcagatcgtcgtcgtgatgtttatgcacataagtcgggcgaggcggttgttgagctcctgaagcggggtataaccgcaagagatattttgacaaaagaggcatttgaaaatgcgatagcagttgttatggcccttggcggatctacaaacgccgttttgcatttacttgcgatagctcatgaggcccatgtgccactgacgatagacgattttaacaaaatcgggaatagggttcctcatattgcagacctcaagccttttgggcgctatgtaatgaatgatgtagatcgcgtgggaggtattccagttgttataaatgcattgatgcgggaaggttttatacacggtgatgtaattaccgtttcaggcagaacaatggccgaggagatatctgatatcaatccgggccttcccgacggaaaggttatacactctttttcctcacctctgcacccaacaggcggtataaaggtattaaaaggtacgcttgcaccggatggggccgttgcaaaaacagctggtttcgatactgtggtttttcaaggccccgcaatggtgtttgatcgcgagcgcgcggctatggatgctctcagtgctgggaatataaaaaaggggagcgttattgttattcgctatgaaggcccaaaagggggtccgggtatgcgagagatgctggctattaccgcggcaataaagggaagtggccttggtaaagatgttttattgttgacagacggcaggttctcgggcggtacaaccggtctgtgtatagggcatattgcgccagaggcggttgatcttgggccgattgcgtttgtgcaagatggcgatataatccgcgttgatattgagaaatcgagtattgatgttctggttgatgaaaagcaattgcgcgccaggcacttgactccacccccacccaggtatacaagcggtgttctttcaaaatattcaaaactcgtcaaatctgcttctttgggtgcaataacttag

SEQ ID NO: 46 - protein, 569 aa, Tropheryma whipplei
MFMSSDANACEIDIKPRSRVVTHGIEATTSRGMLRAVGMGDADWEKPQIGIASSWNNITPCNLSLDRLAQGAREGVHAAGGYPLQFCTISVSDGISMGHEGMHFSLVSREVITDSVETVLMAEALDGVVLLAGCDKSLPGMLMAAARLDVSAVFLYAGSIAPGYVTLKCGESKEVTIIDSFEAVGAYKAGLIDQDDLGRIERAICPGEGACGGMYTANTMASVAEALGMSLLGSASPPSADRRRDVYAHKSGEAVVELLKRGITARDILTKEAFENAIAVVMALGGSTNAVLHLLAIAHEAHVPLTIDDFNKIGNRVPHIADLKPFGRYVMNDVDRVGGIPVVINALMREGFIHGDVITVSGRTMAEEISDINPGLPDGKVIHSFSSPLHPTGGIKVLKGTLAPDGAVAKTAGFDTVVFQGPAMVFDRERAAMDALSAGNIKKGSVIVIRYEGPKGGPGMREMLAITAAIKGSGLGKDVLLLTDGRFSGGTTGLCIGHIAPEAVDLGPIAFVQDGDIIRVDIEKSSIDVLVDEKQLRARHLTPPPPRYTSGVLSKYSKLVKSASLGAIT

SEQ ID NO: 47 - DNA, 1731 bp, Methylobacterium extorquens
atggacgcgcgtcagaccgacaagtcgaagctgccgagccggcacgtgacggaggggcccgagcgggcgccccaccgctcgtacctctacgccatgggcctgacgaccgagcagatccaccagccgctggtcggcgtcgcctcgtgctggaacgaggccgcgccctgcaacatctcgctgatgcgccaagcccaggccgtgaagaagggtgtcgccgccgccaagggcactccgcgcgagttctgcaccatcaccgtcaccgacggcatcgccatgggccatggcggtatgcgcgcctcgctgccttcccgcgaggtcatcgccgattcggtcgagctgacgatccgcggccattcctacgacgccctcgtggggctggccggctgcgacaagtccctgcccggcatgatgatggccatggtgcgcctcaacgtgccctcgatcttcatctatggcggctcgatcctgccgggctcgttccgcggccggccggttacggtgcaggatctgttcgaggcggtcggcaaggtcgccgtcggcgacatgagcctcgacgacctcgacgagctggagcgggttgcctgcccctcggccggcgcctgcggcgcgcagttcaccgccaacaccatggccaccgtctccgaggcgatcggcctcgcgctgccctactcggccggcgcgcctgccccttacgagatccgcgaccaattctgcgccgccgccggcgagaaggtgatggagctgatcgccaagaacatccgcccgcgcgacatcgtcacccgcaaggcgctggagaacgccgccgcgacggtcgcggcctcgggcggctcgaccaacgcggccctgcacctgccggcgatcgcgcatgaatgcggcatcgagttcaccctgttcgacgtcgccgagatcttccgcaagaccccctacatcgccgacttgaagcccggcgggcgctatgtggccaaggacatgttcgaggtcggcggcatcccgctgctgatgaagacgctgctcgaccacggctacctgcacggcgactgcctcaccgtcaccggccgcaccatcgccgagaacctcgccaaggtcgcctggaacccggatcaggacgtggtgcgcccggccgacaagcccatcaccgtcaccggcggcgtggtgggcctgcgcggcaatctcgcccccgagggcgcgatcgtgaaggtcgccggcatgccgcccgaggcccaggtcttcaccggcccggcccgcgtcttcgacggcgaggaagcctgtttcgaggcggtgcagaaccgcacctacaagcccggcgacgttctggtcatccgttacgagggcccgaagggaggccccggcatgcgcgagatgctctcgaccaccgccgccctctacggccagggcatgggcgacaaggtggccctcatcaccgacgggcgcttctccggcgcgacccgcggcttctgcgtcggccatgtcggccccgaggctgccatcggcgggccgatcggcctgctgcgcgacggcgacatcatcaccctcgatgcgatcaagggcacgctcgacgtggcgctctccgacgaggaactggcccagcgtcgcagcgaatggacgccgcggggcaatgccgcgacctccggctacctctggaaatacgcgcagtccgtcgggcctgcagtgaacggggccgtgacgcatccgggcggcgcgggggagacgaacgtctatgccgacatctag

SEQ ID NO: 48 - protein, 576 aa, Methylobacterium extorquens
MDARQTDKSKLPSRHVTEGPERAPHRSYLYAMGLTTEQIHQPLVGVASCWNEAAPCNISLMRQAQAVKKGVAAAKGTPREFCTITVTDGIAMGHGGMRASLPSREVIADSVELTIRGHSYDALVGLAGCDKSLPGMMMAMVRLNVPSIFIYGGSILPGSFRGRPVTVQDLFEAVGKVAVGDMSLDDLDELERVACPSAGACGAQFTANTMATVSEAIGLALPYSAGAPAPYEIRDQFCAAAGEKVMELIAKNIRPRDIVTRKALENAAATVAASGGSTNAALHLPAIAHECGIEFTLFDVAEIFRKTPYIADLKPGGRYVAKDMFEVGGIPLLMKTLLDHGYLHGDCLTVTGRTIAENLAKVAWNPDQDVVRPADKPITVTGGVVGLRGNLAPEGAIVKVAGMPPEAQVFTGPARVFDGEEACFEAVQNRTYKPGDVLVIRYEGPKGGPGMREMLSTTAALYGQGMGDKVALITDGRFSGATRGFCVGHVGPEAAIGGPIGLLRDGDIITLDAIKGTLDVALSDEELAQRRSEWTPRGNAATSGYLWKYAQSVGPAVNGAVTHPGGAGETNVYADI

SEQ ID NO: 49 - DNA, 1734 bp, Methylobacterium nodulans
atggacgcgcgtcacaccatcgacaagtcgaagctgccgagccgctatgtcaccgaggggccggcccgggcgccgcatcgctcgtatctctatgcgatggggctgacgcgggagcagatccaccagccgctggtgggcgtcgcctcctgctggaacgaggccgccccctgcaacatcgcgctcatgcgccaggcgcaggcggtgaagaagggcgtcgccgccgcggccggtaccccgcgggaattctgcaccatcacggtcaccgacggcatcgccatgggccaccggggcatgcgcgcctcgctgccctcccgggaggtcatcgccgattccgtcgagctcaccatgcggggccacgcctacgacgccctggtggggctcgcgggctgcgacaagtccctgcccggcatgatgatggcgatggtgcgcctgaacgtgccgtcgatcttcatctatggcggctcgatcctgcccggctccttccgcgggcggccggtcacggtccaggacctgtttgaggcggtcggcaagcactccgtcggccagatgagcgacgaggatctggacgagctggagcaggtcgcctgcccgtcggccggcgcctgcggggcgcagttcaccgccaacacgatggcgaccgtctccgaggcgatcggcctcgcgctgccctattcggccggcgcgcccgctccctacgagatccgcgacaagttctgcgcggcggccggcgagatggtgatggatctcctcgccaagaacatccgcccgcgcgacatcatcacccgcaaggcgctggagaacgccgccacggtggtcgccgcctccggcggctcgaccaatgcggcgctgcacctgccggccatcgcccacgaggcgggcatcgtcttcgacctgttcgacgtcgccgagatcttccggcgcacgccctacatcgccgacctcaagccgggcgggcgctacgtcgccaaggacctgttcgaggccggcggcatcccgctcctgatgaagaccctgctggaccacggcttcctgcacggcgactgcatcaccgtgaccggccgcaccatcgccgagaacctcgccaaggtggcctggaacccggaccaggacgtcgtgcggccggccgacaccccgatcaccccgaccggtggcgtggtcggcctcaagggcaacctcgcccccgagggcgcgatcgtgaaggtcgccggcatgccggccgaccgccaagtattcgccggcccggcccgcgtcttcgacaacgaggaagcctgtttcgaggcggtgcagaaccgccagtacaaggagggcgacgtcctcgtcatccgctacgagggcccgaagggcggccccggcatgcgcgagatgctggcgaccaccgccgccctctacggccagggcatgggcgacaaggtcgcgctcatcacggacggccgcttctcgggcgcgacccgcggcttctgcgtcggccatgtcgggcccgaggccgcaatcggcggcccgatcggccttctcaaggacggggacatcatccggctcgacgcgatccagggcatcctctcggtcgatctctccgacgaggaactggccgagcgccgcaaggcctggaccccgcgcgcgaacgaggcgacctccggctatctctggaaatacgcgcagaccgtcggcccggcggtgaccggcgccgtgacgcatccgggcggagcccaggagacgctcacctatgcggacatctga

SEQ ID NO: 50 - protein, 577 aa, Methylobacterium nodulans
MDARHTIDKSKLPSRYVTEGPARAPHRSYLYAMGLTREQIHQPLVGVASCWNEAAPCNIALMRQAQAVKKGVAAAAGTPREFCTITVTDGIAMGHRGMRASLPSREVIADSVELTMRGHAYDALVGLAGCDKSLPGMMMAMVRLNVPSIFIYGGSILPGSFRGRPVTVQDLFEAVGKHSVGQMSDEDLDELEQVACPSAGACGAQFTANTMATVSEAIGLALPYSAGAPAPYEIRDKFCAAAGEMVMDLLAKNIRPRDIITRKALENAATVVAASGGSTNAALHLPAIAHEAGIVFDLFDVAEIFRRTPYIADLKPGGRYVAKDLFEAGGIPLLMKTLLDHGFLHGDCITVTGRTIAENLAKVAWNPDQDVVRPADTPITPTGGVVGLKGNLAPEGAIVKVAGMPADRQVFAGPARVFDNEEACFEAVQNRQYKEGDVLVIRYEGPKGGPGMREMLATTAALYGQGMGDKVALITDGRFSGATRGFCVGHVGPEAAIGGPIGLLKDGDIIRLDAIQGILSVDLSDEELAERRKAWTPRANEATSGYLWKYAQTVGPAVTGAVTHPGGAQETLTYADI

SEQ ID NO: 51 - DNA, 1725 bp, Rhodopseudomonas palustris
atggacgcgaaggcgacgctcaagtcgaagctccccagccggcacgtgaccgaagggccggcgcgcgcgccccatcgctcttacctctacgccatgggcctcaccaccgagcagatccaccagccgttcgtcggggtggcgtcgtgctggaacgaggccgcgccctgcaacatttcgctgatgcggcaggctcaggcggtcaagaagggcgtcgcctccgccggcggcaccccgcgcgaattctgcaccatcaccgtgactgacggcatcgccatgggccacgagggcatgcgctcgtcgctgccgtcgcgcgaggtgatcgccgactccgtcgagctgacaatccgcggccactcctatgacgcgctggtcgggctggccggctgcgacaagtctctgcccgggatgatgatggcgatggtccggctcaacgtgccgtcgatcttcatctatggcggctcgatcctgccgggcaccttccggggccagcaggtcaccgttcaggacatgttcgaggcggtcggcaagcactcggtcggcgagatgtcggacgacgacctcgacgaaatcgagcgggtcgcctgtccgtcggccggcgcctgcggcgcgcagttcaccgccaacaccatggcgaccgtgtccgaggcgatcggcctagcgctgccgtattcggccggcgcacctgctccttacgaaatccgcgatgcgttctgcacggcggccggcgagaaggtgatggagctgatcgccgccaacatccggccgcgcgacatcgtcacccgcaaggcgctggagaatgcggccgcggtggtagcagcgtccggcggctcgaccaatgctgcgctgcacctaccagcgatcgcgcatgaatgtggtatcaagttcgatctgtttgatgtcgccgaaatcttcaaaaagacaccatatatcgcggatttgaagccaggcggccgttatgtcgccaaagacatgtatgaagttggcggcataccgctcctgatgaagaccctgctcgatcatggcttcctccacggcgactgcctgaccgtcacgggacggacgatcgccgagaatctgaaagccgtgaagtggaatccgcatcaggacgtggtgcggcaggcgaaccatccgatcaccgtgactgggggcgtcgtcgggctgaagggaaacctcgcaccagaaggtgcgatcgtgaaggtcgcgggaatgtcgaacctgaagttttccgggcctgcccgctgcttcgatcgcgaggaagacgcgttcgaggcggtgcagaagcggacctacaaggaaggcgaggtcctcgtgatccgctacgaggggccgcggggcggccccggaatgcgggaaatgctcgccaccactgcggcgctgaccggccagggcatgggcggcaagatcgcgctgatcaccgacggccggttctccggcgccacccgcggcttctgcatcggccatgtcggcccggaagcggcgctgggtggtccgatcgcgctgctgcgcgacggtgacatcatcgtcatcgacgccgaggccggaacgcttgacgtaaatttgaccgacgacgaactggccgcgcgcaagtccgaatgggcgcatcgcgcgacaaaccacacgtcgggtgcgctttggaaatatgcccagcaggtcgggcccgcagtcagcggcgctgtgactcatccgggcggggcggccgagaagcagtgctatgcggatgtttga

SEQ ID NO: 52 - protein, 574 aa, Rhodopseudomonas palustris
MDAKATLKSKLPSRHVTEGPARAPHRSYLYAMGLTTEQIHQPFVGVASCWNEAAPCNISLMRQAQAVKKGVASAGGTPREFCTITVTDGIAMGHEGMRSSLPSREVIADSVELTIRGHSYDALVGLAGCDKSLPGMMMAMVRLNVPSIFIYGGSILPGTFRGQQVTVQDMFEAVGKHSVGEMSDDDLDEIERVACPSAGACGAQFTANTMATVSEAIGLALPYSAGAPAPYEIRDAFCTAAGEKVMELIAANIRPRDIVTRKALENAAAVVAASGGSTNAALHLPAIAHECGIKFDLFDVAEIFKKTPYIADLKPGGRYVAKDMYEVGGIPLLMKTLLDHGFLHGDCLTVTGRTIAENLKAVKWNPHQDVVRQANHPITVTGGVVGLKGNLAPEGAIVKVAGMSNLKFSGPARCFDREEDAFEAVQKRTYKEGEVLVIRYEGPRGGPGMREMLATTAALTGQGMGGKIALITDGRFSGATRGFCIGHVGPEAALGGPIALLRDGDIIVIDAEAGTLDVNLTDDELAARKSEWAHRATNHTSGALWKYAQQVGPAVSGAVTHPGGAAEKQCYADV

SEQ ID NO: 53 - DNA, 1725 bp, Rhodopseudomonas palustris
gtggacgccaactccaacatcaaggcgaggttgcccagccgtcacgtgacggaaggcccggagcgtgcgccgcaccgctcctacctctatgcgatggggttgaccacgcagcagatccaccagccgttcgtcggcgtggcatcgtgctggaatgaagccgcgccctgcaacatctcgctgatgcgccaggcccaggcggtgaagaagggcgtcgccgccgcgggtggtacgccacgcgaattctgcaccatcaccgtcaccgacggcatcgccatgggccatgacggcatgcgctcgtcgctgccgtcgcgcgaatgcatcgccgactcggtcgagctgaccatccgcggccactcctacgacgcgctggtcgggcttgccggctgcgacaagtcgctgcccggaatgatgatggcgatggtccggctcaacgtgccgtcgatcttcatctatggcggctcgatcctgcccggcaccttccgcggccagcaggtcaccgtgcaggacatgttcgaggcggtcggcaagcattcggtcggcgcgatgtcggacgccgacctcgacgaaatcgaacgggtggcgtgcccctcggccggcgcctgcggcgcccagttcaccgccaacaccatggcgacggtgtcggaggcgatcggcctggcgctgccttattcggccggagcacctgcgccctatgagatccgcgacgccttctgcatgaccgccggcgagcagatcatgacgctgatcgccaagaatatccggccgcgcgacatcgtcaccttgaaggcgctgcagaacgccgcggcggtggtggcggcctccggcggctcgaccaatgcggcgctgcacctgccggcgatcgcgcatgaatgcggcatcaaattcgacctgttcgacgtcgccgaaatcttcaaaaagacaccctatgtcgcggatttgaaacccggcggccgttatgtcgccaaagacatgtacgaagttggtggcataccgcttctgatgaaaacattgctcgatcatggctacctgcacggcgactgcctgacggtcaccggccggacgattgcggaaaatttggcaaccgtgaaatggaatcccgaccaggacgtggtgcgcgcagcggataacccgatcaccgtgaccggtggggtggtcgggctgcaaggcaacctcgcccccgagggggcgatcgtgaaggtcgccgggatgtccaacttgaaattctccggcccggcgcgctgcttcgatcgcgaagaggacgccttcgaggcggtgcagcacaagacctatcgcgaaggcgaagtgatcgtgatccgctacgaagggccgcgcggcggccccggcatgcgcgagatgctgtcgaccaccgcggcgctgaccgggcagggcatgggcggcaagatcgcgctgatcaccgacggccggttctccggcgccacccgcggcttctgcatcggccatgtcggaccggaagccgcgctcggcggcccgatcgcgctgttgcaggacggcgacatcatcgagatcgacgcggtggccggcacgcttaacgtaaaattgaccgaagccgaactctccgcgcgcaagaccaattggcagccgcgtgagaccaaccattcgtcaggcgcgttgtggaagtatgcccaacaggtcggccccgcgctcggtggcgcggtgacccatccgggtggttcgcacgagaaacagtgttatgcggatgtttaa

SEQ ID NO: 54 - protein, 574 aa, Rhodopseudomonas palustris
MDANSNIKARLPSRHVTEGPERAPHRSYLYAMGLTTQQIHQPFVGVASCWNEAAPCNISLMRQAQAVKKGVAAAGGTPREFCTITVTDGIAMGHDGMRSSLPSRECIADSVELTIRGHSYDALVGLAGCDKSLPGMMMAMVRLNVPSIFIYGGSILPGTFRGQQVTVQDMFEAVGKHSVGAMSDADLDEIERVACPSAGACGAQFTANTMATVSEAIGLALPYSAGAPAPYEIRDAFCMTAGEQIMTLIAKNIRPRDIVTLKALQNAAAVVAASGGSTNAALHLPAIAHECGIKFDLFDVAEIFKKTPYVADLKPGGRYVAKDMYEVGGIPLLMKTLLDHGYLHGDCLTVTGRTIAENLATVKWNPDQDVVRAADNPITVTGGVVGLQGNLAPEGAIVKVAGMSNLKFSGPARCFDREEDAFEAVQHKTYREGEVIVIRYEGPRGGPGMREMLSTTAALTGQGMGGKIALITDGRFSGATRGFCIGHVGPEAALGGPIALLQDGDIIEIDAVAGTLNVKLTEAELSARKTNWQPRETNHSSGALWKYAQQVGPALGGAVTHPGGSHEKQCYADV

SEQ ID NO: 55 - DNA, 1725 bp, Bradyrhizobium sp.
atggacgcgaagaccgacatcaagcgcaggctgcccagccgtcatgtgacggaagggccggagcgtgcgcctcatcggtcgtatctctacgcgatgggcctgaccacggcccaaatccatcagcccttcgtcggcgtcgcctcgtgctggaacgaggccgcgccctgcaacatcgcgctgatgcggcaggcgcaagccgtgaagaagggcgtggcccacgccggcggcacgccgcgcgaattctgcaccatcaccgtgaccgacggcatcgccatgggccatgacggcatgcgctcgtcgctgccgtcgcgcgaggcgattgccgattcggtcgagctgacgattcgcggtcatgcctacgacgcgctggttggcctcgccggctgcgataaatcgctgccgggcatgatgatggcgatggtccggctcaacgtgccgtcgatcttcatttatggaggctcgatcctgcccggcaatttccgcggccagcaggtcaccgtgcaggacatgttcgaggcggtcggcaagcattcggtcggcgcgatgtcggatgaggatctcgacgagctcgagcgcgtcgcctgtccgtcggccggtgcgtgcggtgctcagttcacggccaacacgatggcgaccgtctccgaggcgatcggcctggcgctgccgtactcggctggcgcgcccgcaccttacgagatccgcgattccttctgcatgaccgccggcgagaaggtcatggagctgatatcagccaacatccggccgcgcgacatcgtgacgcgagcagcactcgagaatgccgctgcggttgtggcggcctccggcggctcgaccaacgcggccctgcatctaccagcgattgcacacgaggccggcatcaagttcgacttattcgatgtcgccgaaatcttcaaaaagacaccttatatcgcggatttgaagccgggtggccgctatgtcgccaaagacatgttcgaggctggtggcattccgctcttgatgaagacgttgctcgaccatggctatttgaacggcgactgcctcacagtcaccggccggacgatcgccgaaaacctcaaaggcgtgaagtggaatccgcaccaggacgtggtgaggccggccgaccagccgatcactgcaaccggaggtgtcgttggtttgaaaggcaatctcgcgccagagggtgcgatcgtgaaagtcgcgggcatgtcgaacttgaaattcactgggccggcccgctgcttcgatcgggaagaggatgcctttgaagccgttcagaagcggtcctatcgcgagggcgaggtcatcgtcatccgctatgagggcccgcgcggcggtcccggcatgcgggaaatgctgcagaccacggcggcgctgacggggcagggcatgggcggcaagatcgcgctcatcaccgatggccggttctcgggcgcgacgcgcggcttctgcatcggccatatcgggccggaggcggcggtcggcggaccgatcgcgctggtcgaggatggcgacatcatcgagatcgacgccgaggcgggcatcctgaacgtcaagttgagcgatgccgaactgacacaacgcaagaccaagtggacgccgcgtgaaacgcatcacacgtcaggtgcactttggaaatatgcccagcaggtgggacccgccgtggcgggggccgtcacccacccaggtggtgcgcaagagaagtattgctatgcggacatctga

SEQ ID NO: 56 - protein, 574 aa, Bradyrhizobium sp.
MDAKTDIKRRLPSRHVTEGPERAPHRSYLYAMGLTTAQIHQPFVGVASCWNEAAPCNIALMRQAQAVKKGVAHAGGTPREFCTITVTDGIAMGHDGMRSSLPSREAIADSVELTIRGHAYDALVGLAGCDKSLPGMMMAMVRLNVPSIFIYGGSILPGNFRGQQVTVQDMFEAVGKHSVGAMSDEDLDELERVACPSAGACGAQFTANTMATVSEAIGLALPYSAGAPAPYEIRDSFCMTAGEKVMELISANIRPRDIVTRAALENAAAVVAASGGSTNAALHLPAIAHEAGIKFDLFDVAEIFKKTPYIADLKPGGRYVAKDMFEAGGIPLLMKTLLDHGYLNGDCLTVTGRTIAENLKGVKWNPHQDVVRPADQPITATGGVVGLKGNLAPEGAIVKVAGMSNLKFTGPARCFDREEDAFEAVQKRSYREGEVIVIRYEGPRGGPGMREMLQTTAALTGQGMGGKIALITDGRFSGATRGFCIGHIGPEAAVGGPIALVEDGDIIEIDAEAGILNVKLSDAELTQRKTKWTPRETHHTSGALWKYAQQVGPAVAGAVTHPGGAQEKYCYADI

SEQ ID NO: 57 - DNA, 1725 bp, Bradyrhizobium japonicum
atgaacgcaaagaccaacatcaagcagaggctgccgagccgtcacgtgacggaaggccctgcgcgcgcgccccatcgctcctacttctacgccatgggtctgacgacggagcagatccaccagcccttcgtcggcgtcgcctcctgctggaacgaggccgcgccctgcaacatcgctttgatgcgccaggcgcaggcggtgaagaagggcgtcgcgcatgccggcggcacaccccgcgaattctgcaccatcaccgtgaccgacggcatcgccatgggccatgacggcatgcgctcctcgctgccgtcgcgcgaatgcatcgccgattccgtcgagctgaccgtccgcggccatgcctatgacgccctcgtcggccttgccggctgcgacaagtcgctgccgggcatgatgatggcgatggttcgcctcaacgtgccctcgatcttcatctatggcggctcgatcctgcccggcaacttccgcgggcagcaggtcaccgtgcaggacatgttcgaggccgtcggcaagcactcggtcggcgccatgtcggacgaggatctcgacgagatcgagcgcgtggcgtgcccctcggcgggtgcctgcggcgcgcagttcacggccaacaccatggcgaccgtctcggaagccatcggccttgcgctgccttactcggccggtgctccggcaccgtatgaaatccgcgacgccttctgcatgaccgcgggcgagaaggtgatggagctgatcgaccagaacatccggccgcgcgacatcgtcacccgcaaggcgctggagaatgcggccgccgtggtcgcggcctccggcggctcgaccaatgctgcgctgcacctgccggcgatcgcgcacgagtgcggcatcaagtttgacttattcgacgtcgccgaaatcttcaaaaagacaccatatgtcgcggatttgaagccgggcggccgttatgtcgccaaagacatgtttgaagtaggtggcatcccgcttctgatgaagacgctgctcgacaacggatttctccacggcgactgcattacggtcaccggtcgaacgatcgccgaaaacctcaagagcgtgaagtggaatccgcaccaggatgtggtgcacccggcagacaagccgatcaccgtcaccggtggtgtggtgggtctgaagggcaatttggcgccagaaggtgcgatcgtgaaagtcgcgggaatgtccaacctgaggtttaccggtccggcacgctgcttcgaccgggaagaggacgccttcgaggccgtccagaaccgcacataccgcgaaggcgaagtcatcgtgatccgctacgagggccccaagggcggccccggcatgcgggaaatgctccagaccaccgcggcgctgaccgggcagggcatgggcggcaagatcgcgctcatcactgacggccgcttctccggcgccacccgcggcttctgcatcggccatgtcgggccggaagccgccatcggcggcccgatcgggctgctcgaggatggcgacatcatcgagatcgacgcggtcgccggcacccttaacgtaaaattgagcgaccaggagcttgcccagcgcaagaccaaatggagcgctcgcgcgactaaccacacgacgggcgcgctctggaaatatgctcagcaggttggaccagcggtcgggggggcggtcacccatccgggcggtgcgcacgagaaacagtgctatgcggacatctag

SEQ ID NO: 58 - protein, 574 aa, Bradyrhizobium japonicum
MNAKTNIKQRLPSRHVTEGPARAPHRSYFYAMGLTTEQIHQPFVGVASCWNEAAPCNIALMRQAQAVKKGVAHAGGTPREFCTITVTDGIAMGHDGMRSSLPSRECIADSVELTVRGHAYDALVGLAGCDKSLPGMMMAMVRLNVPSIFIYGGSILPGNFRGQQVTVQDMFEAVGKHSVGAMSDEDLDEIERVACPSAGACGAQFTANTMATVSEAIGLALPYSAGAPAPYEIRDAFCMTAGEKVMELIDQNIRPRDIVTRKALENAAAVVAASGGSTNAALHLPAIAHECGIKFDLFDVAEIFKKTPYVADLKPGGRYVAKDMFEVGGIPLLMKTLLDNGFLHGDCITVTGRTIAENLKSVKWNPHQDVVHPADKPITVTGGVVGLKGNLAPEGAIVKVAGMSNLRFTGPARCFDREEDAFEAVQNRTYREGEVIVIRYEGPKGGPGMREMLQTTAALTGQGMGGKIALITDGRFSGATRGFCIGHVGPEAAIGGPIGLLEDGDIIEIDAVAGTLNVKLSDQELAQRKTKWSARATNHTTGALWKYAQQVGPAVGGAVTHPGGAHEKQCYADI

SEQ ID NO: 59 - DNA, 1725 bp, Fulvimarina pelagi
atggacgcacgcgtgatcgacaagacgaaacttccgagccgtcatgtgacggaaggaccgacccgcgcgccgcaccgctcgtatctctatgcgatgggtctctccaaggaagagatccatcagccactggtcggtgttgcctcctgctggaacgaggccgcaccctgcaatatctcgctgatgcgtcaggcgcaggtcgtaaaaaagggcgttgctgccgcacacggaacgccgcgcgaattctgcacgattaccgtcaccgacggtattgccatgggccatcagggcatgaagtcgtcgctggtctcgcgcgatctcatcgccgactcggtcgaactcaccatgcgaggccactcctacgacgcgcttgtcggtcttgccggctgcgacaagtcgctgccaggcatgatgatgtcgatggtacgcctcaacgttccctcggtcttcatctacggtggctcgattctgcccggcaccttcaagggccggcaggtgaccgtgcaggatattttcgaggcggttggccagcattccgtcggcgagatgtcggacgaggatctcgacctgatcgaacaggttgcctgcccctccgccggttcctgcggcgcccagttcacagcgaacaccatggcgacggtcgcagaggcgatcggccttgcgctgccatactcctgcggtgcgccggcgccttacgaaatccgcgaccgcttctgctacgcctcgggcgagatcgtgatggatcttctgcgccgtaacatccgtccgcgcgacatcgtcacccgcaagtcgctggagaatgcggcggccgtcgtcgcggccacgggcggctcgaccaatggcgcgctgcatctgccggcgatcgcccatgagtgtggcatcgagttcgatctcttcgacgtcgccgagatcttccgcaagacgccctacgtcgcggacctcaaaccgggtggcaaatacgtcgccaaggacatgttcgaggccggcggcattccgctcctgatgaagaccatgctggagcacggctatctccacggcgactgcatgacggtcaccggacgcacgatggccgagaacatggagaaggtcgcctggaacgcggatcaggatgtggttcgcccagccaacaatccgatcacgaagaccggcggtgttgtcggcctgaagggcaatctcgcttccgacggtgcgatcgtgaaggtcgcgggcatgaagaacctgaaattctcagggccagcgcgctgtttcgattcggaggaggattgtttcaaagcggtttcggctcgcgactataaggagggcgaggttctcgtcattcgctacgagggtccgaaaggtggccccggcatgcgcgagatgcttcagacgaccgctgcgatctacggccagggaatgggcgacaaggtcgccctcatcactgatggccgcttttccggcgccacccgcggcttctgcatcggccatgttggcccggaagcggcggtcggcggaccgatcggccttttgaaagacggcgacgtgattacgatcgacgcagtcgagggaacgctggacgttgcattgagcgaagatgaactcgccgagcgccgcaaggcttgggagccgcgcgaaaccgactatcagtcgggcgcgctctggaagtatgcccaggtggttggcacggcccgtctcggtgccgtcacccatcccggcggtgcagccgagaggcagtgctatgcggacatctaa

SEQ ID NO: 60 - protein, 574 aa, Fulvimarina pelagi
MDARVIDKTKLPSRHVTEGPTRAPHRSYLYAMGLSKEEIHQPLVGVASCWNEAAPCNISLMRQAQVVKKGVAAAHGTPREFCTITVTDGIAMGHQGMKSSLVSRDLIADSVELTMRGHSYDALVGLAGCDKSLPGMMMSMVRLNVPSVFIYGGSILPGTFKGRQVTVQDIFEAVGQHSVGEMSDEDLDLIEQVACPSAGSCGAQFTANTMATVAEAIGLALPYSCGAPAPYEIRDRFCYASGEIVMDLLRRNIRPRDIVTRKSLENAAAVVAATGGSTNGALHLPAIAHECGIEFDLFDVAEIFRKTPYVADLKPGGKYVAKDMFEAGGIPLLMKTMLEHGYLHGDCMTVTGRTMAENMEKVAWNADQDVVRPANNPITKTGGVVGLKGNLASDGAIVKVAGMKNLKFSGPARCFDSEEDCFKAVSARDYKEGEVLVIRYEGPKGGPGMREMLQTTAAIYGQGMGDKVALITDGRFSGATRGFCIGHVGPEAAVGGPIGLLKDGDVITIDAVEGTLDVALSEDELAERRKAWEPRETDYQSGALWKYAQVVGTARLGAVTHPGGAAERQCYADI

SEQ ID NO: 61 - DNA, 1815 bp, Aurantimonas sp.
ttgccgccacaaaacccgctcaccccagaggtgctgatcgggcgcggcgtcgaggcgggccatgaacagcgttgtgtacgagggggaccgatggacgcgcattcgatcgacaagaagaacctgcccagccggcatgtgaccgaggggccgtcgcgcgcgccgcaccgctcgtacctctacgccatgggtctcaccaaggaagagatccatcagccgctggtcggcgtcgcctcctgctggaacgaggccgcgccgtgcaacatctcgctgatgcgccaggcgcaggtcgtcaagaagggcgtcgcggcagcccgcggtacgccgcgcgagttctgcaccatcaccgtcaccgacggcatcgccatgggccatcagggcatgaaggcttcgctcgtctcgcgcgacctcatcgccgattcggtcgaactgaccatgcgcggccacgcctatgacgcgctggtgggtctggcaggttgcgacaagtcgcttccgggcatgatgatggcgatggttcgcctgaacgtgccgtcggtcttcatctatggcgggtcgatcctgccgggcaatttccgcggccagcaggtcaccgttcaggacatcttcgaggcggtcggcaagcattcggtcggcgagatgaacgacgccgatctcgacgagatcgagcaggtcgcctgtccgtcagccggttcctgcggcgcgcagttcaccgccaacaccatggcgaccgtcgccgaggccattggcctggcgctgccctattcctgcggtgcgccggcgccctacgagatccgcgacaagttctgctacgcctcgggcgagatcgtcatggaactcttggcccgcaacatccggccgcgcgacatcgtcacccgcaaggcgttggagaacgccgccgccgtcgtcgcggcgaccggcggatcgaccaatggcgccctgcacctgccggcgatcgcgcatgagtgcggcatcgagttcgacctgttcgacgtcgcggagatcttccgcaagacgccgtacatcgccaacctcaagccgggcggcaaatacgtcgccaaggacatgttcgaggccggcggcatcccgatgctgatgaagaccatgctggaccatggctatctgcacggcgactgcatgaccgtcaccggccgcaccattgccgagaacatggcgaaggtgacctggaacccgaaccaggacgtcatccatccggccaacacgccgatcacccagaccggcggcgtcgtcggcctgaagggtaacctcgcccaggacggcgccatcgtgaaggtcgcgggcatgaagaacctgcggttctccggcccggcgcgctgcttcgattcggaagaggaatgctacgaggccgtctccaagcgccagtacaaggaaggcgaggttctcgtcatccgctacgagggcccgcgcggcggacccggcatgcgcgagatgctgtcgaccacggcggcgctctacggccagggcatgggcgacaaggtcgcgctgatcaccgacggccggttctccggcgcgacccgcggcttctgcatcggccatgtcggtccggaagcggcgctcggcggtccgatcggcctgctgcgcgacggtgacatcatcaccatcgatgccgtcgccgggacactggacgtggacgtctcggatgacgacatgaagaagcgggccgaagactggaagccccgcgaaaccgactaccagtccggtgccatctggaaatacgcccagcaggtcggcacggcgcgcctcggcgcagtgacacatccgggcgcagcggcggaaaagcactgttatgcggacctctag

SEQ ID NO: 62 - protein, 604 aa, Aurantimonas sp.
MPPQNPLTPEVLIGRGVEAGHEQRCVRGGPMDAHSIDKKNLPSRHVTEGPSRAPHRSYLYAMGLTKEEIHQPLVGVASCWNEAAPCNISLMRQAQVVKKGVAAARGTPREFCTITVTDGIAMGHQGMKASLVSRDLIADSVELTMRGHAYDALVGLAGCDKSLPGMMMAMVRLNVPSVFIYGGSILPGNFRGQQVTVQDIFEAVGKHSVGEMNDADLDEIEQVACPSAGSCGAQFTANTMATVAEAIGLALPYSCGAPAPYEIRDKFCYASGEIVMELLARNIRPRDIVTRKALENAAAVVAATGGSTNGALHLPAIAHECGIEFDLFDVAEIFRKTPYIANLKPGGKYVAKDMFEAGGIPMLMKTMLDHGYLHGDCMTVTGRTIAENMAKVTWNPNQDVIHPANTPITQTGGVVGLKGNLAQDGAIVKVAGMKNLRFSGPARCFDSEEECYEAVSKRQYKEGEVLVIRYEGPRGGPGMREMLSTTAALYGQGMGDKVALITDGRFSGATRGFCIGHVGPEAALGGPIGLLRDGDIITIDAVAGTLDVDVSDDDMKKRAEDWKPRETDYQSGAIWKYAQQVGTARLGAVTHPGAAAEKHCYADL

SEQ ID NO: 63 - DNA, 1725 bp, Hoeflea phototrophica
atgagcgtcaaagcattcgacaagtccaagcttccaagccgctacacaacggtcggcccggcgcgggcgccgcacagatcgttcctgtatgctatggggctttcgagcgaggagattgctcagccgctcgttggcgtggcgtcgtgctggaatgaggccgcaccctgcaacatttcgctgatgcgccaggcgcaggtggtgaagaaaggcgtggcttcggcccacggcacaccgcgcgaattctgcaccatcacagtgactgatggcattgcgatgggtcaccagggcatgaaagcttccctggcgagccgcgatctgattgcagattcggtggaattgaccatgcgcggtcactgctacgatgcgatcgtgggtcttgccgggtgcgacaagtcattgccgggcatgatgatgtcgatggtgcgtctgaacgtgccctcgatcttcatctatggcggttctattttgccaggcagcttccgcggccgccagattaccattcaggacgtgttcgaggccgtggggcagcattcggttggcgatatgtcggatgaagacctgctcgaaatcgagcaggttgcctgtccgtcggcgggttcctgcggcgcgcagttcacagccaacacgatggcgactgttgccgaggcgatcggactggcgctgccctattcatgtggcgcgccggcgccttacgagatccgcgaccggttcgcttacgcggccggtgaaaaagtgatggaattgctggccaagcagatccgtccgcgcgacatcgtgacccgcaaggcgctcgaaaacgccgcggccgtcgtcgcggcttcgggcggttcgaccaacgcggcgctgcatctgccagcgattgcgcatgaatgcgggatcgagttcgatctgtttgacgtggctgagatcttcaagaagacgccctacattgccgacctcaagcccggcggcaaatatgtggccaaggacatgttcgaggctggtggcattccgctgttgatgaagaccatgcttgaacatggctatctgcacggcgattgcatgaccgtgacgggccggaccatcgccgagaacatggagaaggtctcctggaacccggagcaggatgtggtgcgcccggcggataagccgatcaccgcgaccggcggtgtggtgggcctcaagggcaatcttgcgaccgacggggcgatcgtgaaagttgccgggatggaacggctgaaattcaccggacccgcacggtgttttgattccgaggaagagtgcttcaatgcggtcacaaatcgcgactataacgaaggcgacgttcttgtgatccgctacgaggggcccaagggcggccccggtatgcgtgagatgctgtcgaccactgcggccatttatggacagggtatgggcgacaaggtggcattgatcacggatggccggttctccggtgcaacgcgcggcttctgcattggccatgtcggcccggaagcggcggaaggcgggccgatcgggctcctggaagatggcgacatcatcgagatcgatgctgttgatggtgttttgagcgtgcagctttccgatgcggaactggctgcgcgcagggaaaagtggacggcgcgcgaaaccgattatgcatcgggcgtgctgtggaaatatgcccagacggtgggggccgcgcgttacggcgccgttacccatccgggcggagcaaaagaaaagcagtgctatgcggatatctga

SEQ ID NO: 64 - protein, 574 aa, Hoeflea phototrophica
MSVKAFDKSKLPSRYTTVGPARAPHRSFLYAMGLSSEEIAQPLVGVASCWNEAAPCNISLMRQAQVVKKGVASAHGTPREFCTITVTDGIAMGHQGMKASLASRDLIADSVELTMRGHCYDAIVGLAGCDKSLPGMMMSMVRLNVPSIFIYGGSILPGSFRGRQITIQDVFEAVGQHSVGDMSDEDLLEIEQVACPSAGSCGAQFTANTMATVAEAIGLALPYSCGAPAPYEIRDRFAYAAGEKVMELLAKQIRPRDIVTRKALENAAAVVAASGGSTNAALHLPAIAHECGIEFDLFDVAEIFKKTPYIADLKPGGKYVAKDMFEAGGIPLLMKTMLEHGYLHGDCMTVTGRTIAENMEKVSWNPEQDVVRPADKPITATGGVVGLKGNLATDGAIVKVAGMERLKFTGPARCFDSEEECFNAVTNRDYNEGDVLVIRYEGPKGGPGMREMLSTTAAIYGQGMGDKVALITDGRFSGATRGFCIGHVGPEAAEGGPIGLLEDGDIIEIDAVDGVLSVQLSDAELAARREKWTARETDYASGVLWKYAQTVGAARYGAVTHPGGAKEKQCYADI

SEQ ID NO: 65 - DNA, 1761 bp, Mesorhizobium loti
atgcggcaggccgcaccgcccgcggcaaggatgagaatggacgccaaggtcatttcaaaggctaagctccctagccgccatgtgactgtcggtccggcgcgtgcgccgcaccggtcctatctctatgccatggggctttccgccgccgagatcgcgcagccgctggtcggcgtcgcctcctgctggaacgaagccgcgccctgcaacatctcgctgatgcgccaggcgcaggtggtcaagaagggtgtcgccgccgccaacggcacaccgcgcgaattctgcaccatcaccgtcaccgacggcatcgccatgggccaccagggcatgaagtcgtcgctggtgtcgcgcgaggtcatcgccgattcggtcgagctcacgatgcgtggccattgctacgatgcgctggtcggcctcgccggctgcgacaagtcgctgcccggcatgatgatggccatggtgcggctcaacgtgccgtcgatcttcatctatggcggttcgatcctgcccggcagctatcgcggccgtcagattaccgtgcaggacgtgttcgaggcggtcggccagcactccgtcggcacgatcggcgacgccgagctgctcgagatcgagcaggcggcctgtccgtcggccggctcctgcggcgcccagttcaccgccaacaccatggcaaccgtcgccgaggcgatcggtctggcgctgccctattcctgcggcgcgccggcgccttacgaaatgcgcgaccgcttcaatttcgcctccggcgaaaagatcatggagctgatcgccaaaaacatccggccgcgcgacatcatcacgctgaaggcgctggagaacgcggcgaccgtggtttccgccaccggcggttcgaccaatgcggcgctgcatctgccggcgatcgcgcatgaggcgggcatcaaattcgatctcttcgatgtcgcaaggattttcgagaagacgccctacatcgccgacctcaagcctggcggcaaatatgtcgcaaaggacatgttcgaggccggcggcattccgctgttgatgaagacgctgctcgaccacggctatctgcatggcgattgcctgacggtgactggccgcactttggccgaaaacatggagcacgttgcctggaatgaacaccaggatgtggtccgcccggccaacagaccaattacccaaaccggcggtgtcgtgggcttgaagggaaaccttgcccccgaaggcgcgatcgtgaaagtcgcgggcatgacggagttgaaattctccggcccggcgcgctgcttcgattcggaagaggaatgtttcgaggcggtgacgcaacgcaactacagggaaggcgaggttctcgtcattcgctacgaagggccgcgcggtggtcccggcatgcgcgagatgctgtcgacgacggcagcgctctacggccagggcatgggcggcaaggtggcgctgatcaccgacggccgcttctcgggcgcgacgcgcggcttctgcatcggccatgtcgggccggaagcggcggtgggcggcccgatcggcctcatccgggatggcgacgtgatttcgatcgacgccgtgaacggcacgatcgaagtggcgctgtcggatagcgaactggcggcgcgggccaagacatggaaggcgcgcacgaccgactatcagtcgggcgcgatatggaaatacgcacagacggtcgggtctgccagggatggcgcggtcacccatccgggtggtgcgaaagaaacacactgctatgcggatatctga

SEQ ID NO: 66 - protein, 586 aa, Mesorhizobium loti
MRQAAPPAARMRMDAKVISKAKLPSRHVTVGPARAPHRSYLYAMGLSAAEIAQPLVGVASCWNEAAPCNISLMRQAQVVKKGVAAANGTPREFCTITVTDGIAMGHQGMKSSLVSREVIADSVELTMRGHCYDALVGLAGCDKSLPGMMMAMVRLNVPSIFIYGGSILPGSYRGRQITVQDVFEAVGQHSVGTIGDAELLEIEQAACPSAGSCGAQFTANTMATVAEAIGLALPYSCGAPAPYEMRDRFNFASGEKIMELIAKNIRPRDIITLKALENAATVVSATGGSTNAALHLPAIAHEAGIKFDLFDVARIFEKTPYIADLKPGGKYVAKDMFEAGGIPLLMKTLLDHGYLHGDCLTVTGRTLAENMEHVAWNEHQDVVRPANRPITQTGGVVGLKGNLAPEGAIVKVAGMTELKFSGPARCFDSEEECFEAVTQRNYREGEVLVIRYEGPRGGPGMREMLSTTAALYGQGMGGKVALITDGRFSGATRGFCIGHVGPEAAVGGPIGLIRDGDVISIDAVNGTIEVALSDSELAARAKTWKARTTDYQSGAIWKYAQTVGSARDGAVTHPGGAKETHCYADI

SEQ ID NO: 67 - DNA, 1728 bp, Mesorhizobium sp.
atgatggacgctcgtgcgatatcgaaggaaaagctgcccagccgctacgttaccgtagggccggcgcgggcgccgcacaggtcttatctttacgcgatggggctctcggcggaagagatcgctcagccgctggtcggcgtggcgacgtgctggaacgaggctgcgccctgcaacatctcgctgatgcgccaggcgcaagtggtgaaaaagggcgtcgcggcagccaaaggcacgccccgcgagttcacaacgattaccgttactgatggcatcgccatgggccaccagggcatgaaggcgtcgctggcctcgcgcgaggtaatcgcggattctgtggaactcaccatgcgcggccattgctatgacgcgcttgtcggccttgcgggttgtgacaaatccctgccggggatgatgatggccatggtgcgcctcaatgtgccgtcggtcttcatctatggcggttcgatcctgcctggcacctggcgcgggcggcagatcaccgttcaagacgttttcgaggcggtcggccagcattcggttggctccatttccgacgacgagctgatggaaatcgagcaagccgcttgtccctcggccggttcctgcggcgctcaattcacggccaacaccatggcgaccgttgccgaggcgattgggctggcgcttccttattcctgcggtgcgcctgcgccttacgagatgcgcgatcgcttcaactatgccgccggcgagaaggtgatggaactggtggccaagcagatacggccgcgtgacatcgtgacccggaaggcgcttgaaaacgccgcggccgtggttgccgcgtcggggggctccaccaatgcggcattgcatttgccggccatcgctcatgaagccggaattgaattcgaccttttcgacgtcgcggaagtgttcaagagaacaccctatgtcgccgatttgaagccgggcggcaaatatgtcgccaaggacatgttcgaggcgggcggcattccgctgctcatgaagaccttgctcgaccatggctatctgcatggcgactgcatgaccgtcaccggccgcacgcttgcggagaacatggaacgcgtcgagtggaacgatgcgcaggacgtggtttatccggctgacaagccgctgagcccgacgggcggcgtcgtgggccttaaaggcaatctcgcgccggatggggcaatcgtgaaggttgcaggcatgaagaacctgcgcttctccggccccgcgcgctgcttcgattcggaagaggaatgcttcgccgcggtttccgagcgccgctataaggaaggcgaggtgctggtgatccgctacgaaggtccgaaaggcgggccgggcatgcgtgaaatgctcgccaccaccgcggccctttacgggcagggcatgggcgacaaggtggcgctgatcacggacgggcggttttcaggcgcgacccgcggcttctgtatcggtcatgtcgggccggaagcagcagtgggcgggccgatagggcttctcaatgacggcgacatcataaccatcgatgcggtggcaggcacgatcgacgtggcgctcggcgaagcggaactggccgaacgccgcgctgcctggaggccgcgcgaaagcgaatatcggtccggcgcgatctggaaatacgcgcagggcgtgggcccggcgcggtatggcgcggtgacgcatcccggcgcccagaaagaaacgcactgctatgcggatatctga

SEQ ID NO: 68 - protein, 575 aa, Mesorhizobium sp.
MMDARAISKEKLPSRYVTVGPARAPHRSYLYAMGLSAEEIAQPLVGVATCWNEAAPCNISLMRQAQVVKKGVAAAKGTPREFTTITVTDGIAMGHQGMKASLASREVIADSVELTMRGHCYDALVGLAGCDKSLPGMMMAMVRLNVPSVFIYGGSILPGTWRGRQITVQDVFEAVGQHSVGSISDDELMEIEQAACPSAGSCGAQFTANTMATVAEAIGLALPYSCGAPAPYEMRDRFNYAAGEKVMELVAKQIRPRDIVTRKALENAAAVVAASGGSTNAALHLPAIAHEAGIEFDLFDVAEVFKRTPYVADLKPGGKYVAKDMFEAGGIPLLMKTLLDHGYLHGDCMTVTGRTLAENMERVEWNDAQDVVYPADKPLSPTGGVVGLKGNLAPDGAIVKVAGMKNLRFSGPARCFDSEEECFAAVSERRYKEGEVLVIRYEGPKGGPGMREMLATTAALYGQGMGDKVALITDGRFSGATRGFCIGHVGPEAAVGGPIGLLNDGDIITIDAVAGTIDVALGEAELAERRAAWRPRESEYRSGAIWKYAQGVGPARYGAVTHPGAQKETHCYADI

SEQ ID NO: 69 - DNA, 1731 bp, Parvibaculum lavamentivorans
atggacgccaagacattcgacaaatcgaaactgccgagccgccacgtcacggtcgggccggagcgcgcgccgcaccggtcctactactatgcgatgggcctcaccgaggaagagatcaatcagcccttcgtcggcgtggcgacctgctggaacgaggcggctccctgcaacatcgcgttgatgcgtcaggcgcagtcggtgaagaagggtgtcaaggccgccgccggcacgccccgcgaattctgcaccatcacggtgacggacggcatcgccatgggccaccagggcatgaaatcctcgctcgccagccgcgacgtgatcgcggattcggtcgagctcaccatgcgcggtcattgctacgacgcgctggtcggccttgccggctgcgacaagtcgctgccgggcatgatgatgtcgatggttcgtctcaacgtcccctccgtcttcatgtatggcggctcgatcctgccgggccatttcaagggcaaggacgtcaccgtggtcgacgtcttcgaggcggtcggccagcactcggcgggcaacatggaagacgaagagctgcatgcgctcgaatgcgtcgcctgtccctccgccggcgcctgcggcggccagttcacggccaacaccatggcctgcgtttcggaagccatgggcctcgcgctgccgggttcggcgggcgcgcctgcgccttatgagagccgcgacgaatatgcggaagcctcgggccgcgccgtcatgcacctcctcgccaacaacatccggccgcgcgacatcgtcacgcgcaaggcgctcgagaatgccgccgtcatcgtcgcggcgacgggcggttcgaccaatggcgggcttcatctcccggccatcgcgcatgaagcgggcatcgatttcgacctgatggaagtcgccgaaatcttcaagaagacgccctacatcaccgacctgaagcccggcggcaattacgtcgcgaaggatcttcacgaggcgggcggcgtttcgatggtcctcaaggtgctgctcgatggcggctatctccacggcgattgcctcaccgtcaccggccagtcgctcgcagacaacctcaaggacgtgaagttcaacccggaccagaaggtcgtctatccgctgtccaatccgctctcgcccaccggcggcgttgtcgggttgcagggctcgctcgcgccggatggcgccatcgtcaaggtcgcgggcatggagaaggatcatctccgtttctccggtccggcgcgttgcttcgacagcgaagaggaatgcttcgaggcggtcgacaaacgtcagtacaaggaaggtgaggttctcgtcatccgctacgagggaccgaagggtggccccggcatgcgcgaaatgctctccaccaccgccgcgctttacggccagggcatgggcgacaaggtcgcgctcatcaccgatggccgcttctccggcggcacgcgcggtttctgcatcggccatgtcggcccggaagccgccgtcggcggccccatcgcgctgatcgaggatggcgacatcatcaccatcgacgcggagaacggcaccatcgatctcgaagtcgacgaagccgtgctcgaaaagcgccgcgcgaactggaagccccgggagaccatgtacgcctccggcgcgctgtggaaatacgcgcagctcgtcggcaccgcccgcaagggcgccgtcacccatccgggcggcaaggcggagaaacatgtctatgcggatatctga

SEQ ID NO: 70 - protein, 576 aa, Parvibaculum lavamentivorans
MDAKTFDKSKLPSRHVTVGPERAPHRSYYYAMGLTEEEINQPFVGVATCWNEAAPCNIALMRQAQSVKKGVKAAAGTPREFCTITVTDGIAMGHQGMKSSLASRDVIADSVELTMRGHCYDALVGLAGCDKSLPGMMMSMVRLNVPSVFMYGGSILPGHFKGKDVTVVDVFEAVGQHSAGNMEDEELHALECVACPSAGACGGQFTANTMACVSEAMGLALPGSAGAPAPYESRDEYAEASGRAVMHLLANNIRPRDIVTRKALENAAVIVAATGGSTNGGLHLPAIAHEAGIDFDLMEVAEIFKKTPYITDLKPGGNYVAKDLHEAGGVSMVLKVLLDGGYLHGDCLTVTGQSLADNLKDVKFNPDQKVVYPLSNPLSPTGGVVGLQGSLAPDGAIVKVAGMEKDHLRFSGPARCFDSEEECFEAVDKRQYKEGEVLVIRYEGPKGGPGMREMLSTTAALYGQGMGDKVALITDGRFSGGTRGFCIGHVGPEAAVGGPIALIEDGDIITIDAENGTIDLEVDEAVLEKRRANWKPRETMYASGALWKYAQLVGTARKGAVTHPGGKAEKHVYADI

SEQ ID NO: 71 - DNA, 1734 bp, Loktanella vestfoldensis
atgcccagcaaccgtgtcgacaaatccaaattgcccagccgccacgtgactgaaggcccgtctcgcgcgccgcaccggtcctatttttatgcgatgggcctggacgaacatgagatcgcacagccttgggtcggtgtcgccacctgctggaacgaagcagccccctgcaacatcacgctgaaccggcaggcccaagccgtcaaggtcggcgtcaagaacgccaaaggcacgccgcgcgaatttaccacaatcaccgtcaccgatggcatcgccatgggccatgaagggatgcggtcgtcactcgcatcacgcgaagcgattgccgataccgttgaactgacgatgcgcggccattgctatgacgcgctggtcggtctggccggttgcgacaaatccttgcccgggatgatgatggcgatggtgcggctgaacgtgccgtcggtgttcatctatggcggctcaatcctgccgggccggttaaacgggcaggacgtgaccgtccaagacgtgttcgaagcggtgggcaagcatcaggccggtaatatgaccgatgcggagctcgaaatccttgaacgcgtcgcctgcccctctgctggggcttgtggtggacaattcaccgccaacaccatggcctgcgtgtccgaagcaatcggtctggcgctgctcaattcctctggcgcgcctgcgccctacgaatcgcgcgatcaatatggtgtcgcttcgggcgaggccgtgatgaacctgatcgccaagaacatccgcgcgcgcgatatcgtcacgcgcaaatcactggaaaacgcggcacggatcgtggcctgcaccggcgggtccaccaatgccggtctgcacctgcctgcgatcgccgccgaggctggcattgattttgatctgtccgatgtctgcgagattttccgcgatacgccctatttcgtcgatctcaaaccgggcggcaaatatgtggccaaggatctttacgaggcaggcggcgtgcctgtcgtgctgaaagaactgcgcaaggccggtctgatccacgaagattgcatgacagcgacaggccgcgtgatcggtgaagaactggacatgatcaagggtgaggcggataaccgcgtcatctattccgtcgccaatccgatcacgaaaaccggcggtgttgtcggcctgaaaggcaaccttgcccccgaaggcgccatcgtcaaggtcgcgggcatgtccgaggaagaacagatatttaccggccctgcccgcgtgttcgaatgcgaagaagacgcgttcgaggccgtaaaagcccgccaatatgaagaaggcgaagtcatcgttatccgcaacgaaggccctgcaggcggccccggtatgcgcgaaatgctgtccaccaccgccgctttgtcgggccaaggcatgggcaaaaaggtcgcgctgatcaccgacggccgcttttcaggtgcgacacgcgggttctgcgtgggtcacgtcggcccagaggccgcgcagggcggccccatcgcgctgttgaaagacggcgacatgatcacgctgaacgcgcgcaccggcgaattgtcggtggcgctgaccgatgcagaactggccgaacggcgcaaaacctgggctggcccgcgcgaaactatctatgcctcgggagccttgtggaaatatgcacagctggtcggatcgacccgtctgggcgcattgacccatccaggtgccaagggcgaaaaacacatctatatggacctgtaa

SEQ ID NO: 72 - protein, 577 aa, Loktanella vestfoldensis
MPSNRVDKSKLPSRHVTEGPSRAPHRSYFYAMGLDEHEIAQPWVGVATCWNEAAPCNITLNRQAQAVKVGVKNAKGTPREFTTITVTDGIAMGHEGMRSSLASREAIADTVELTMRGHCYDALVGLAGCDKSLPGMMMAMVRLNVPSVFIYGGSILPGRLNGQDVTVQDVFEAVGKHQAGNMTDAELEILERVACPSAGACGGQFTANTMACVSEAIGLALLNSSGAPAPYESRDQYGVASGEAVMNLIAKNIRARDIVTRKSLENAARIVACTGGSTNAGLHLPAIAAEAGIDFDLSDVCEIFRDTPYFVDLKPGGKYVAKDLYEAGGVPVVLKELRKAGLIHEDCMTATGRVIGEELDMIKGEADNRVIYSVANPITKTGGVVGLKGNLAPEGAIVKVAGMSEEEQIFTGPARVFECEEDAFEAVKARQYEEGEVIVIRNEGPAGGPGMREMLSTTAALSGQGMGKKVALITDGRFSGATRGFCVGHVGPEAAQGGPIALLKDGDMITLNARTGELSVALTDAELAERRKTWAGPRETIYASGALWKYAQLVGSTRLGALTHPGAKGEKHIYMDL

SEQ ID NO: 73 - DNA, 1734 bp, Roseobacter sp.
atgcccaaagatcaggtcaataagacacacctgcccagccgccatgtgaccgaaggcccatcgcgcgcgccgcaccggtcgtatttttacgccatgggtctggatgaagaagcgatcaagcaaccttgggttggtgtcgcgacctgctggaacgaagcggccccttgcaacatcgccctgaaccgtcaggcgcagtcggtcaagctgggtgtgaaaaaggcgatgggcacgccgcgcgaatttacaacgattactgtcaccgacggcattgcgatggggcatgaagggatgcgctcttcgctggcgtcacgcgaagcaattaccgatacggttgagctgacgatgcgcggccactgctatgatgcgctggtcggtctggccggttgcgacaaatccctgcccggtatgatgatggcgatggtccgtctgaacgtgccgtccgtctttatctatggcgggtccattctgccgggtcgtctggatggcaaggacgtgactgttcaggacgtgttcgaggctgtgggtaaacaccaagcgggcaatatgactgatgcggaactggaagtgctggaacgtgtagcgtgtccatctgctggcgcttgcggtggtcagtttacggccaatacgatggcttgtgtgtccgaagcgattggtctggccctgatgaattcttccggtgcccctgccccttatgaaagccgcgaccagtatggcattgcatcgggtgaagcggtcatgaacctgattgaaaagaacatccgcgcccgtgatgttgtcacccgcaagtcgcttgagaacgccgcgcgcgttgtggcctgtaccggtgggtccaccaatgccggtctacacctgccggccattgcgcatgaggctggcattgatttcgacctttttgatgtctgcgacatcttccgtgatacgccttattttgtcgatctgaaaccgggtggtcaatatgtggccaaagacctttacgaggctggcggcgtacccgtcgtgctgaaagaactgcgcaaggccggtctgatccacgaggagtgcatgacagcatcaggccggaccatgggcgaagagctggatatgatcaaaggcgaggcggacaataaggtgatctattctatcgaaaacccgctgacaccaaccggtggcgttgttggtttgaagggtaatcttgcccccgaaggtgcgattgtgaaggtcgcggggatgaatacgcaagaacagtcttttacaggtcccgcccgttgctttgaaagcgaagaagatgcgtttgaggctgtgaaagcccgccaatacgaagaaggcgaagtgctggtgatccgcaatgaaggccccgccggtggccccggtatgcgcgagatgctggcgacgactgccgcactgtccggccaaggcatgggcaaaaaggtcgcgctgatcacggatggccgcttttctggtgcgacacgcgggttctgtgtgggtcatgtggggccagaggccgcgcacggtggcccgataggcctgttgcagaacggcgatgtcatcacaatcaacgctgtcactggtgaactgtcagtcgatctgagtgacgaagaactggcgacgcgcaaggcgaattggaaaggcccgaaagagacgatctatgcatccggtgctttgtggaaatacgcgcaacttgtgggtggtgcgcgtttgggtgcggtgacgcatccgggtgcgaagtctgaaaaacacatttacatggacctctga

SEQ ID NO: 74 - protein, 577 aa, Roseobacter sp.
MPKDQVNKTHLPSRHVTEGPSRAPHRSYFYAMGLDEEAIKQPWVGVATCWNEAAPCNIALNRQAQSVKLGVKKAMGTPREFTTITVTDGIAMGHEGMRSSLASREAITDTVELTMRGHCYDALVGLAGCDKSLPGMMMAMVRLNVPSVFIYGGSILPGRLDGKDVTVQDVFEAVGKHQAGNMTDAELEVLERVACPSAGACGGQFTANTMACVSEAIGLALMNSSGAPAPYESRDQYGIASGEAVMNLIEKNIRARDVVTRKSLENAARVVACTGGSTNAGLHLPAIAHEAGIDFDLFDVCDIFRDTPYFVDLKPGGQYVAKDLYEAGGVPVVLKELRKAGLIHEECMTASGRTMGEELDMIKGEADNKVIYSIENPLTPTGGVVGLKGNLAPEGAIVKVAGMNTQEQSFTGPARCFESEEDAFEAVKARQYEEGEVLVIRNEGPAGGPGMREMLATTAALSGQGMGKKVALITDGRFSGATRGFCVGHVGPEAAHGGPIGLLQNGDVITINAVTGELSVDLSDEELATRKANWKGPKETIYASGALWKYAQLVGGARLGAVTHPGAKSEKHIYMDL

SEQ ID NO: 75 - DNA, 1734 bp, Dinoroseobacter shibae
atgctcaagcgttcgttcgacaagtccaagctgcccagccgtcacgtcaccgaaggcccttcgcgcgcgccgcatcggtcctattactatgccatgggcatgaccgaggaagagatccaccagccgctggtcggggtcgccacatgctggaacgaggccgcgccctgcaacatcgcgctcagccgccaggcccaggcggtgaagatgggggtcaagcaggcctccggcacgccacgagaattcaccacgatcaccgtgaccgacgggatcgccatgggccacgagggcatgcggtcctcgctggcctcccgcgaggcgattgccgatacggtcgaattgaccatgcgcggccattgctatgacgcgattgtgggtctggcgggctgcgacaagtccctgccggggatgatgatggccatggtgcggctcaacgtgccgtcggttttcatttatggcggctcgatcctgccgggtcggttgaacggcgaggacgtgacggttcaggacgtgttcgaggccgtgggcaagcaccaggccgggaactacaccgatgcagagctggaagtgctggagcgggtggcttgtccgtccgcaggggcctgtggcggtcagttcaccgccaataccatggcctgcgtgtccgaggcgatcggtctggcgctgccgaattccgcgggcgcacccgcgccctacgagagccgcgaccagtatggcgaggcgtcgggccgcgcggtcatggacctgatcgagaaaggcatccgcgcgcgggacatcgtgacccggaagtcgctggagaatgccgcgcggatcgtggcctgcaccggcgggtcgacgaatgccggtctgcacctgcctgcgattgcccatgaggccgggatcgaattcaccttgcaggatgtctgcgacatcttccgagacacgccctatttcgtggacctcaagccgggcggcaaatacgttgccaaggacatgtacgaagcgggcggcgtgcccgtggtgatgcgcgagctgcgccgcgcgggcctgatccacgaggattgcatgaccgtgaccggctattccatcggcgaggagctcgacaaggtcacgctcgaagccgatggccgggtgatctatccggtcgacacgccgctctcgaccacgggcggggttgtcggtctcgagggtaacctggcgcccgaaggtgccatcgtgaagatcgcgggcatgagcgacgaccagttggtcttcaccggcccggcgcgcgtgttcgaatgcgaagaggacgccttcgaggcggttcagaaccgcgcttacgcggaaggcgacgtcttcgtgatccgcaacgagggtcccgcaggcggtcccggcatgcgcgagatgctggccaccacggcggcgctctcgggtcagggcatgggcaagaaggtggcgctgatcaccgatggccggttctccggggccacgcgcggcttctgcgtcggccatgtgggccccgaagcggcccatggcggccccatcgcgatgctcaaggacggcgacatgatcaccatcgacgcgctgaagggcgagctgtccgtcgcgctgagcgaggatgagcttgccgcgcgaaaagatgcctggagcggcccgcgggagacgatctatgcctcgggtgcgttgtggaaatatgcgcagctggttggcggcgcacgcctgggggcagtcacccatcccggagccaaggatgaaaaacacatctacgccgatctctga

SEQ ID NO: 76 - protein, 577 aa, Dinoroseobacter shibae
MLKRSFDKSKLPSRHVTEGPSRAPHRSYYYAMGMTEEEIHQPLVGVATCWNEAAPCNIALSRQAQAVKMGVKQASGTPREFTTITVTDGIAMGHEGMRSSLASREAIADTVELTMRGHCYDAIVGLAGCDKSLPGMMMAMVRLNVPSVFIYGGSILPGRLNGEDVTVQDVFEAVGKHQAGNYTDAELEVLERVACPSAGACGGQFTANTMACVSEAIGLALPNSAGAPAPYESRDQYGEASGRAVMDLIEKGIRARDIVTRKSLENAARIVACTGGSTNAGLHLPAIAHEAGIEFTLQDVCDIFRDTPYFVDLKPGGKYVAKDMYEAGGVPVVMRELRRAGLIHEDCMTVTGYSIGEELDKVTLEADGRVIYPVDTPLSTTGGVVGLEGNLAPEGAIVKIAGMSDDQLVFTGPARVFECEEDAFEAVQNRAYAEGDVFVIRNEGPAGGPGMREMLATTAALSGQGMGKKVALITDGRFSGATRGFCVGHVGPEAAHGGPIAMLKDGDMITIDALKGELSVALSEDELAARKDAWSGPRETIYASGALWKYAQLVGGARLGAVTHPGAKDEKHIYADL

SEQ ID NO: 77 - DNA, 1728 bp, Roseovarius nubinhibens
atgaccaaattcgacaaagcaaaattgcccagccgccatgtgaccgaaggcccggcgcgtgcgccgcaccggtcctacatgtatgcgatggggcttcaggaagaagaaatccatcagcctctggtcggcgtggcgacctgctggaacgaggcggcgccgtgcaacatttcgctcaaccggcaggcgcaatcggtcaagatgggcgtcaaggaagcgggcggcacgccgcgcgagtttaccaccatcaccgtgaccgacggcatcgccatgggccatgagggcatgcgcagctcgctcgcgtcgcgcgaggcgattgccgacactgtcgagctcaccatgcgcggccattgctatgatgcgctcgtcggtctggcgggctgtgacaagtcgctgccggggatgatgatggcgatggtgcggctcaacacgccgtcggtcttcatctatggcggctcgatcatgccgggccggttccagggccgtgacgtgaccgtgcaggacgtgttcgaggccgtcggccgccatcaggcaggggccaattcggacgaagagctgcgggcgctggaaaaggtggcctgcccgtcggccggggcctgtggcggccagttcaccgccaacaccatggcctgtgtctctgaagcgatcggtctggcgctgcccaactcggcgggcgcgcccgcgccctatgaaagccgcgatcaatatggcaccgcctctggtgcggcggtcatgacgcttttggaaaagaacatccgggcgcgcgacatcgtcacgctcaagagccttgagaatgccgcgcgggtcgtggcctgtaccggtgggtcgaccaatgccggtctgcacctgcccgcgattgcgcatgaggcggggctcgagtttttcctcgatgacgtctgccagatcttcaaggacacgccctatttcgtcgatctcaaaccgggcgggcaatatgtcgccaaggacctctatgaggcgggcggcgtgccggtggtgatgaaggagctgcgcaaggcggggctcatccacgaagattgcatgaccgtcaccgggcggaccattggcgaagagatcgacatcgtcgagcgcgaggccgatggccgggtgatctatcccgtcgagaagccgatcaccaagaccggcggcgtcgtgggcctcaagggcaatcttgccccgcagggcgccatcgtgaaggtcgcgggtatgagcgaggaagagcaagtcttctcgggccccgcgcgggtttttgaatgcgaagaggacgcctttgaggcggtcaaggcgcgcagctacaaggagggcgaggttctcgtcatccgcaacgagggccccgcaggcggtccgggcatgcgcgagatgctcgccaccacggcggcgctgtcggggcagggcatgggcaagaaggtcgcgctcatcaccgatggccggttctcgggcgcgacgcgtggcttctgcgtcggccatgtcggaccggaatcggcccatggcggcccgattgccctggtccaggatggcgatgtgatcaccatcaacgcgatcaccggcgagctcagcgtggcgctcagcgatgaggatctgacggcccgcaaggaggcctggaaaggcccgcgcgagacgatctattccagcggcgcgctgtggaaatacgcccagctcgtgggcgagacctacaagggcgctgtgacccaccccggtgccgaagcggagaagcatgtctatatggatctctaa

SEQ ID NO: 78 - protein, 575 aa, Roseovarius nubinhibens
MTKFDKAKLPSRHVTEGPARAPHRSYMYAMGLQEEEIHQPLVGVATCWNEAAPCNISLNRQAQSVKMGVKEAGGTPREFTTITVTDGIAMGHEGMRSSLASREAIADTVELTMRGHCYDALVGLAGCDKSLPGMMMAMVRLNTPSVFIYGGSIMPGRFQGRDVTVQDVFEAVGRHQAGANSDEELRALEKVACPSAGACGGQFTANTMACVSEAIGLALPNSAGAPAPYESRDQYGTASGAAVMTLLEKNIRARDIVTLKSLENAARVVACTGGSTNAGLHLPAIAHEAGLEFFLDDVCQIFKDTPYFVDLKPGGQYVAKDLYEAGGVPVVMKELRKAGLIHEDCMTVTGRTIGEEIDIVEREADGRVIYPVEKPITKTGGVVGLKGNLAPQGAIVKVAGMSEEEQVFSGPARVFECEEDAFEAVKARSYKEGEVLVIRNEGPAGGPGMREMLATTAALSGQGMGKKVALITDGRFSGATRGFCVGHVGPESAHGGPIALVQDGDVITINAITGELSVALSDEDLTARKEAWKGPRETIYSSGALWKYAQLVGETYKGAVTHPGAEAEKHVYMDL

SEQ ID NO: 79 - DNA, 1734 bp, Sagittula stellata
gtgctcaagcgtccgtttgacaagaccaaactgcccagccgtcacgtcactgagggtcccgcccgcgcgccgcatcgctccttcatgtacgccatggggttgagcgaagaagagatccatcagcctcttatcggtgtcgcgacctgctggaacgaggccgcgccctgcaacatctcgctgagccggcaggcgcaggcggtgaagctgggtgtcaaggaagcctccggcacgccgcgcgaattcaccaccatcaccgtgaccgacggcatcgcgatgggccacgaggggatgcgtgcttcgctggcctctcgcgaagccatcgccgatacggtcgagctgacgatgcgcggccactgctacgacgcgcttgtggggcttgcgggctgcgacaagtcactgcccgggatgatgatggcaatggtgcggctcaatgtgccgtcggtcttcatctatggcgggtcgatcatgccgggcaagttccagggccgcgacatcaccgttcaggacgtgttcgaggccgtgggcaagcaccaggcgggcgccaactccgacgaggaactgcgcgccatcgagaaggcggcctgtccctcggccggggcctgcggcggccagttcaccgccaacaccatggcctgcgtgtccgaggccatcggccttgcgttgttgaattcttccggcgcgccagcgccttacgaaagccgcgaccagtacggcaccgcgtccggcatcgccgtgatgaacctgctggagcgcaacatccgcgcccgcgacatcgtcacgatgaagtctctggaaaacgcggcgcgggtggtcgcctgcaccggcggttcgaccaacgccggtctgcacctgcccgccatcgcacatgaggcagggctggaattcttcctagacgacgtgtgcgagatcttccgcgacacaccctatttcgtcgacctgaagcccggcggcaactatgtggccaaggacctttacgaggtcggtggcgttccggttgtgatgaaggagctgcgcgaggcgggcctgatccacgaggactgcatcaccgcatcggggcgatcaatgggagaggaactcgacctgatcgagcgcgaggccgatggcaaagtcatctatcccatagaaacgccgatcaccaagaccggcggcgtcgtgggcctgaagggcaacctcgccccgcagggcgccatcgtgaaggtcgcgggaatcgcggcggaggaccaggtgttcaccggtcccgcgcgtgtcttcgaatgcgaggaagactgctttgaagcggtcaagatgcgcgcctacaaggagggcgaggtgctggtcatccgcaacgagggccccgcaggcggccccggcatgcgcgagatgctggctaccaccgccgccctgtccgggcagggtatgggcaagaaggttgcactgatcaccgacggccgcttttccggtgcgacgcgcggtttctgcgtgggccacgtcggcccagaggcggcgcacggcgggccgatcgcgctggtggaaaccggcgatgtcatcaccatcaacgcacagaccggagagctgtccgtggacctgacggacgagcaactggcggcccgcaaggacgcttggagcgggccgcgggacacgatctatgcctccgggtcgctgtggaaatatgcgcaactcgttggggagacatacaaaggcgccgtcacccatccaggtggcaaggcggagaaacacgtctacgccgatctctga

SEQ ID NO: 80 - protein, 577 aa, Sagittula stellata
MLKRPFDKTKLPSRHVTEGPARAPHRSFMYAMGLSEEEIHQPLIGVATCWNEAAPCNISLSRQAQAVKLGVKEASGTPREFTTITVTDGIAMGHEGMRASLASREAIADTVELTMRGHCYDALVGLAGCDKSLPGMMMAMVRLNVPSVFIYGGSIMPGKFQGRDITVQDVFEAVGKHQAGANSDEELRAIEKAACPSAGACGGQFTANTMACVSEAIGLALLNSSGAPAPYESRDQYGTASGIAVMNLLERNIRARDIVTMKSLENAARVVACTGGSTNAGLHLPAIAHEAGLEFFLDDVCEIFRDTPYFVDLKPGGNYVAKDLYEVGGVPVVMKELREAGLIHEDCITASGRSMGEELDLIEREADGKVIYPIETPITKTGGVVGLKGNLAPQGAIVKVAGIAAEDQVFTGPARVFECEEDCFEAVKMRAYKEGEVLVIRNEGPAGGPGMREMLATTAALSGQGMGKKVALITDGRFSGATRGFCVGHVGPEAAHGGPIALVETGDVITINAQTGELSVDLTDEQLAARKDAWSGPRDTIYASGSLWKYAQLVGETYKGAVTHPGGKAEKHVYADL

SEQ ID NO: 81 - DNA, 1758 bp, Roseobacter sp.
atgaccaaattcgacaaatccaaactgcccagccgttacgtgaccgaaggaccggcccgcgcgccgcatcggtcctattactatgccatgggcatgaccgaggccgagatccatcagccgctggtcggcgtggcgacctgctggaacgaggcggcgccgtgcaacatcgcgctcaaccgtcaggcgcaggccgtcaagggcggcgtcaaggaagcgcatggcagcccgcgtgaattcaccacgatcaccgtgaccgacgggatcgccatgggccatgaaggcatgcgcagctcgcttgccagccgcgaggcgattgccgacactgtcgagctgaccatgcggggccattgctatgacgcgcttgtgggtcttgcgggctgtgacaagtcgctgccgggcatgatgatggcgatggtgcggctcaatgtgccgtcagtgttcatctatggcgggtcgatcctgccgggcaaggcgcctcaggtgaacgaaatccccgaagaattccgcaaccgcgacctgacggtgcaggatatgttcgaagcggtcggctggcaccagaacgagcagatgtccgacaaggcgctcgatatgctcgaacgcgtcgcctgcccctcggcgggcgcttgcggcgggcagttcaccgccaacacaatggcctgcgtctccgaggcgatcggccttgcgctgatgaacagctcgggcatgcccgcgccctacgaatcccgcgaccaatatgccgaggcgtcgggccgcgcggtcatgacccttctggaaaagaacatccgtgcgcgggacgtggtcaccctccaaagcctgcagaacgccgcgcgcgtcgtggcctgcaccggcggctccaccaatgcgggcctgcaccttccggccatcgcccatgaggcggggatcgacttcttcctcgaagatgtctgcgagattttccgcgacacgccctatttcgtcgatctcaagcccggtggtcagtatgtggccaaggatctctatgatgcgggcgggattcccgtcgtgatgaaagagctgcgcaaggcggggctgatccacgaggattgcatcaccgcctcgggccgctccatcggcgaagagcttgacctgatcgaacgcgaggccgatggccgcgtgatctatccgatcgaaaagccgatcaccaagaccggcggtgtcgtcggcctcaagggcaatcttgcgccgcaaggcgccatcgtgaaggtcgcgggcatcgcccccgagcatcaggtcttcaccggcccggcgcgcgtgttcgaatgcgaagaggacgcgttcgaggcggtcaaggcgcgccaatacaaggaaggcgaggtcatcgtgatccgcaacgaaggccccgcaggcggccccggcatgcgcgagatgctgtccacgaccgccgcgctgtccgggcagggcatgggcaagaaggttgcgcttatcaccgatgggcgcttttcgggcgccacacgcgggttctgtgtgggccatgtcggccccgaggcggcgcatggtggcccgatcgccctgatccagaccggcgatgtggtcaccatcgacgcgatcaagggcgaactgagcgtcgatctatcggacgaggagctggccaagcgcaaggaaaactgggccggcccgcgcgagacgatctatgccaccggtgcgatctggaaattcgccaagcttgtgggcgagacctacaagggggctgtcacccatcccggcggcaaggccgagcggcatgtctacatggacctctga

SEQ ID NO: 82 - protein, 585 aa, Roseobacter sp.
MTKFDKSKLPSRYVTEGPARAPHRSYYYAMGMTEAEIHQPLVGVATCWNEAAPCNIALNRQAQAVKGGVKEAHGSPREFTTITVTDGIAMGHEGMRSSLASREAIADTVELTMRGHCYDALVGLAGCDKSLPGMMMAMVRLNVPSVFIYGGSILPGKAPQVNEIPEEFRNRDLTVQDMFEAVGWHQNEQMSDKALDMLERVACPSAGACGGQFTANTMACVSEAIGLALMNSSGMPAPYESRDQYAEASGRAVMTLLEKNIRARDVVTLQSLQNAARVVACTGGSTNAGLHLPAIAHEAGIDFFLEDVCEIFRDTPYFVDLKPGGQYVAKDLYDAGGIPVVMKELRKAGLIHEDCITASGRSIGEELDLIEREADGRVIYPIEKPITKTGGVVGLKGNLAPQGAIVKVAGIAPEHQVFTGPARVFECEEDAFEAVKARQYKEGEVIVIRNEGPAGGPGMREMLSTTAALSGQGMGKKVALITDGRFSGATRGFCVGHVGPEAAHGGPIALIQTGDVVTIDAIKGELSVDLSDEELAKRKENWAGPRETIYATGAIWKFAKLVGETYKGAVTHPGGKAERHVYMDL

SEQ ID NO: 83 - DNA, 1758 bp, Roseovarius sp.
atgaccaagttcgacaaagccaaactgcccagccgtcacgtgaccgaagggcccgagcgcgcgccgcatcggtcctattactatgccatgggcatgaccgagacggaaattcatcagccgctcgtgggcgtggcgacctgctggaacgaagcagccccctgcaacatcgcgctgaaccgtcaggcgcaggcggtcaagggtggcgtgaaagaggcgcatggcagcccgcgtgagtttaccacgatcacggtcacggacgggattgcgatggggcatgagggcatgcggtcgagccttgcgagccgggaggcaattgccgatacggtggaattgaccatgcgtggacattgctatgacgcgctggttggtttggcgggttgtgacaaatccctgcctggaatgatgatggcgatggtgcggttgaacgtgccgtccgtgttcatttatggcgggtcgatcctgccgggcaaggccccgcaggtcgaggagattccggcggatttccgcagccgtgatctgaccgtgcaggacatgttcgaggcggtggggcggcatcagaacaacgagatgtccgacaaggcgctggatatgctggagcgggtggcctgcccatcggcgggggcctgtggcgggcagttcaccgccaacaccatggcctgtgtttctgaggcgattggtctggcgttgatgaattcctcgggtatgcctgccccttatgaaagccgcgatcaatatgccgaggcgtctggtcgtgcggtgatgcatcttttggagcgcaacatccgggcgcgggacgtggtgacgctcaagtcgttgcagaatgcggcgcgggttgtggcctgcaccggtggcagcaccaatgccggtttgcacctgcctgcgattgcgcatgaggcggggattgatttctttctcgaagatgtctgcgacatcttccgcgacacgccctatttcgtcgatctgaaaccgggcggggcctatgtggccaaagacctttatgatgccggtggtatcccggttgtgatgaaggaattgcgcaaggccggtctgattcatgaggattgcatcaccgcgagcgggcgcagcatcggcgaggagctggacctgatcgagcgcgaagccgatggcaaggtcatctatccgattgaaacgccgatcaccaagacggggggcgttgtcggtctcaagggcaatctggccccgaccggcgcgattgtgaaagtggcgggcattgcgcccgagcatcaggtctttaccggcccggcgcgggtgtttgaatgtgaagaagacgcattcgaggccgtcaaagcgcgcgcctataaagagggcgaggtgatcgtcatccgcaatgaaggcccggcaggcggccccggcatgcgcgagatgctgtcgaccacagcggcgctgagcggtcagggcatgggcaagaaggtggcgctgatcaccgacgggcggttctctggggcgacacgcgggttctgtgtgggccatgttggaccagaggccgcgcatggtggcccgattgccttgattgccacgggcgacatgatcacgattgacgcgatcaagggggaattgtcggttgatctgagcgacgaggaactggccaagcgcaaggacgcttggggcgggccgcgcgagacgatctataccagcggggcgctgtggaaatatgcgcaattggtgggcgagacctataagggcgctgtgacccatcccggcgcagcgttcgagcggcatgtctatatggacctctga

SEQ ID NO: 84 - protein, 585 aa, Roseovarius sp.
MTKFDKAKLPSRHVTEGPERAPHRSYYYAMGMTETEIHQPLVGVATCWNEAAPCNIALNRQAQAVKGGVKEAHGSPREFTTITVTDGIAMGHEGMRSSLASREAIADTVELTMRGHCYDALVGLAGCDKSLPGMMMAMVRLNVPSVFIYGGSILPGKAPQVEEIPADFRSRDLTVQDMFEAVGRHQNNEMSDKALDMLERVACPSAGACGGQFTANTMACVSEAIGLALMNSSGMPAPYESRDQYAEASGRAVMHLLERNIRARDVVTLKSLQNAARVVACTGGSTNAGLHLPAIAHEAGIDFFLEDVCDIFRDTPYFVDLKPGGAYVAKDLYDAGGIPVVMKELRKAGLIHEDCITASGRSIGEELDLIEREADGKVIYPIETPITKTGGVVGLKGNLAPTGAIVKVAGIAPEHQVFTGPARVFECEEDAFEAVKARAYKEGEVIVIRNEGPAGGPGMREMLSTTAALSGQGMGKKVALITDGRFSGATRGFCVGHVGPEAAHGGPIALIATGDMITIDAIKGELSVDLSDEELAKRKDAWGGPRETIYTSGALWKYAQLVGETYKGAVTHPGAAFERHVYMDL

SEQ ID NO: 85 - DNA, 1758 bp, Oceanicola batsensis
atgacgaaattcgacaaatcccggctgcccagccgatacgtcaccgaaggacccgagcgcgcgccgcaccgctcctacctctatgccatggggatttccgaagaagagatccaccagccgctcgtcggcgtggcgacctgctggaacgaggccgcgccctgcaacatcgcgctgaaccgccaggcgcaggccgtcaagctgggcgtgaaggcgcgcgaaggcacgccgcgcgaattcaccaccatcaccgtcaccgacggcatcgccatgggccacgaggggatgcgatcctccctcgcctcgcgcgaggccatcgccgacacggtggagctgaccatgcgcggccactgctacgacgcgatcgtcggactggcgggctgcgacaagtccctgcccggcatgatgatggccatggtacgtctgaacgtgccctcggtcttcatctacggcggttcgatcctgcccggcaaggcaccgcaggtcgacgagatccccgaggacttccgcacccgcgacctgaccgtgcaggacatgttcgaagcggtcggccgtcaccagaacaaggagttgtcggacgctgcgctcgacatgctggaacgggtggcctgcccctcctccggcgcctgcggcggccagttcaccgccaataccatggcctgcgtctccgaggcgatcgggctggcgctgctcaactcctccggcatgcctgcgccctacgagagccgcgaccagtacggcgaggcctcgggccgcgcggtcatgaacctgatcgagaagaacatccgcgcccgcgatgtcgtcacccgcaagtcgctggaaaacgccgcgcgcgtcgtggcctgcaccggcggctcgaccaacgccggcctgcacctgcccgcgatcgcgcacgaggccggcatcgactttcaccttgatgacgtctgcgagatcttccgcgacacaccctatttcgtgaacctcaagccgggcggcgaccacgtggccaaggacctgttcgacgtcggcggcatcccggtggtgatgaacgaactgcgcaaggccggcctgatccacgaggactgcgtcacggcctcgggcaagaccatcggcgaggaactcgacaccgtcacccgcaaggccgacggcaaggtgatctatccgatcgagacgccgatcaccaagaccggcggcgtggtgggcctcaagggcaacctcgcccccgaaggcgccatcgtgaaggtcgcgggcatttcggccgaggatcagaagttcaccggccccgcccgggtcttcgaatgcgaggaagacgcctttgccgccgtgcagaaacgggaatacgaggaaggcgaggtcatcgtcatccgcaacgagggccccgcgggcggtcccggcatgcgcgagatgctggccaccaccgccgccctgtccggccagggcatgggcaagaaggtcgcgctgatcaccgacggccgcttttccggcgcgacgcgcggcttctgcgttggccatgtcggccccgaggcagcgcatggcggcccgatcgcgatgctcaagaacggcgacatgatcaccatcgacgccatcgagggttcgatcgaggtcgacctctccgaggccgaactcgaggcgcgcaaggccgactggacgggccctcgcgagacgatctacgcctcgggcgcgctctggaaatatgcgcagctggtcggcaagacctatctcggcgctgtcacccatcccggcggcaaggccgagaaacatatctatgccgatctctga

SEQ ID NO: 86 - protein, 585 aa, Oceanicola batsensis
MTKFDKSRLPSRYVTEGPERAPHRSYLYAMGISEEEIHQPLVGVATCWNEAAPCNIALNRQAQAVKLGVKAREGTPREFTTITVTDGIAMGHEGMRSSLASREAIADTVELTMRGHCYDAIVGLAGCDKSLPGMMMAMVRLNVPSVFIYGGSILPGKAPQVDEIPEDFRTRDLTVQDMFEAVGRHQNKELSDAALDMLERVACPSSGACGGQFTANTMACVSEAIGLALLNSSGMPAPYESRDQYGEASGRAVMNLIEKNIRARDVVTRKSLENAARVVACTGGSTNAGLHLPAIAHEAGIDFHLDDVCEIFRDTPYFVNLKPGGDHVAKDLFDVGGIPVVMNELRKAGLIHEDCVTASGKTIGEELDTVTRKADGKVIYPIETPITKTGGVVGLKGNLAPEGAIVKVAGISAEDQKFTGPARVFECEEDAFAAVQKREYEEGEVIVIRNEGPAGGPGMREMLATTAALSGQGMGKKVALITDGRFSGATRGFCVGHVGPEAAHGGPIAMLKNGDMITIDAIEGSIEVDLSEAELEARKADWTGPRETIYASGALWKYAQLVGKTYLGAVTHPGGKAEKHIYADL

SEQ ID NO: 87 - DNA, 1764 bp, Oceanicola granulosus
atgctcaagggcaagctggacaagtcgaaactgccgagccgccatgtgaccgacggtccggcccgcgcgccgcatcggtcctacctctacgcgatgggcctctcggacgaggagatcgcgcagccgctggtcggcgtcgccacctgctggaacgaggccgcgccctgcaacatcgcgctgaaccggcaggcgcagtcggtcaagctgggcgtgcgcgccgcctcgggcacgccgcgcgagttcaccacgatcaccgtcaccgacgggatcgccatgggccacgaggggatgcgctcgtcgctggcgagccgcgaggcgatcgccgacaccgtcgagctgaccatgcgcggccattgctacgacgcgctcgtcgggctcgcgggctgcgacaagtcgctgccggggatgatgatggcgatggtgcggctcaacgtgccgtcggtgttcatctacggcggctcgatcctgccgggcaaggtgccggccggcgccgacgtcccggccgacttcgccacccgcgacctgaccgtgcaggacatgttcgaggcggtcggccggcaccaggccggcgatctgtccgatgccgcgctcgacgtgctcgagcgggtcgcctgcccctccgccggggcctgcggcggccagttcaccgccaacaccatggcctgcgtctccgaggcgatcggcctggcgctgatgaactcctccggcgcgcccgcgccctacgagagccgcgaccagtacagcgtcgcctcgggcgaggcggtgatgaagcttctcgagagcaacatccgcgcccgcgacgtcgtcacccgcaagagcctcgagaacgccgcccgggtcgtcgcctgcaccggcggctcgaccaacgccggcctgcacctgccggccatcgcgcacgaggcggggatcgacttcgacctgttcgacgtctgcgacatcttccgcgacaccccctacttcgtcgacctcaagcccggcggccagtacgtggctaaggacctgttcgaggccggcggcgtgcccgtggtgatgaaggagctgcgcaaggccgggctgctgcacgaggactgcatcaccgccagcggcgagacgctcggcgaggcgctcgacaagatcaccggcgaggccgacggccgcgtcatccatcccgtcgccaccccgatcagcaagaccggcggcgtcgtcgggctgaagggcaacctcgccccggaaggtgcgatcgtgaaggttgccggcatggacgccgagcagcaggtcttcaccggcccggcgcgggtgttcgagtgcgaggaggacgccttcgaggcggtcaaggcgcgcagctacaaggaaggcgaggtcatcgtcatccgcaacgagggccccgccggcggccccggcatgcgcgagatgctggccaccaccgccgcgctctccgggcagggcatgggcaagaaggtcgcgctcatcaccgacggccgcttctcgggcgcgacgcgcggcttctgcgtcggccatgtcggccccgaggccgcccatggcgggccgatcgcgatgctcgagaatggcgacatgatcaccatcgacgccatcaagggcgagatctccgtcgcgctgaccgaggagcagttcgccgagcgcaaggccgcctggccgggcgcgcgcaagacggactacgcctcgggcgcgctgtggaagtacgcccagctcgtcggctccacccgtctcggcgcggtgacccatccgggcgcgaaggcggagacgcacgtctacatggatctctga

SEQ ID NO: 88 - protein, 587 aa, Oceanicola granulosus
MLKGKLDKSKLPSRHVTDGPARAPHRSYLYAMGLSDEEIAQPLVGVATCWNEAAPCNIALNRQAQSVKLGVRAASGTPREFTTITVTDGIAMGHEGMRSSLASREAIADTVELTMRGHCYDALVGLAGCDKSLPGMMMAMVRLNVPSVFIYGGSILPGKVPAGADVPADFATRDLTVQDMFEAVGRHQAGDLSDAALDVLERVACPSAGACGGQFTANTMACVSEAIGLALMNSSGAPAPYESRDQYSVASGEAVMKLLESNIRARDVVTRKSLENAARVVACTGGSTNAGLHLPAIAHEAGIDFDLFDVCDIFRDTPYFVDLKPGGQYVAKDLFEAGGVPVVMKELRKAGLLHEDCITASGETLGEALDKITGEADGRVIHPVATPISKTGGVVGLKGNLAPEGAIVKVAGMDAEQQVFTGPARVFECEEDAFEAVKARSYKEGEVIVIRNEGPAGGPGMREMLATTAALSGQGMGKKVALITDGRFSGATRGFCVGHVGPEAAHGGPIAMLENGDMITIDAIKGEISVALTEEQFAERKAAWPGARKTDYASGALWKYAQLVGSTRLGAVTHPGAKAETHVYMDL

SEQ ID NO: 89 - DNA, 1728 bp, Rhodobacterales bacterium
atgacgaaatttgacaaaaccaacctgcccagccgccatgtaaccgagggtcctgcgcgtgcgccgcatcgttcgtatttatatgctatggggttgtctgaagatgaaattcaccagcctctagtcggtgttgccacatgctggaacgaggcggccccctgtaatatcgccctgaaccgtcaggcgcaatctgtgaaaatgggcgtcaaacaagcgatgggtacgccacgcgaattcaccacgattaccgttacagacggtattgcgatgggtcacgaaggtatgcgttcgtctttggccagccgcgaggcaatcgctgacacggttgaattgaccatgcgcggtcattgctatgatgcgatcgttggtcttgctggttgtgacaagtcattgcccggtatgatgatggcgatgatccgtttaaacacaccgtctgtgtttgtttatggcggttcaatcttgcccggtcgttacgagggtcgcgatgttactgtacaggacgtttttgaggccgtcggccagcaccaagctggaaacctttcgtcttgcgagcttgaaaaactagaagcggttgcttgtccttctgcgggtgcttgtggtggtcagtttaccgccaacaccatggcttgtgtttccgaggcaatcggtcttgccttgccaaattccgcgggcgcaccggcaccgtatgaaagccgtgatcaattctgcgaggcatccggccgcgctgttatgaatttgatcgccaaaaacattcgtgcgcgtgacatcgtaacacgtaaatcattggaaaatgcggcacgtgttgttgcttgtactggtggttcaacgaatgcaggtcttcacttgccagccatggcgcatgaggcaggcattgatttttatctggatgacgtttgtgacatcttccgcgaaacgccttatttcgtcgatctgaaaccaggtggtaattatgtagccaaagacctttatgaggttggtggcgttcccgtaattatgcgtgaattgcgcaaagcggggttgatccacgaggattgcatgacagccactggccgcacaatgggcgaagagattgatcttgttgatcgcgaagcggacggtaaagtgatttaccccgttgatgccccgttgacgaaaactggcggcgttgttggccttaaaggtaacttggccccagaaggcgcgattgtgaaagtggcgggtatcccatcacagcaccaagtgttttccggccctgcccatgtttttgaatgtgaacaggacgcttttgaagccgtgcaaaaccgtgactacaaagaaggcgaagtattcgtcattcggaacgaaggcccatcaggtggccctggcatgcgtgaaatgttggcaacgaccgccgccctttctggtcaaggcatgggtaaaaagatcgccctgattacagatggtcgcttttctggtgcaacacgtggtttctgtgttggtcacgttggaccagaggcggctcatggtggcccgattgcgttggttgaaaatggtgacatcatcaccatcaatgcaattgaaggcgaaatttcggttaatttgactgatgatgagttggctgaacgtaagacaaactggaaaggaccacgcgaaacgatctatgcgtctggtgctttgtggaaatacagtcagcaagttggcgaagtatacaagggtgctgttacccatccaggtggcaaagccgaaaaacacgtttacatggatttgtaa

SEQ ID NO: 90 - protein, 575 aa, Rhodobacterales bacterium
MTKFDKTNLPSRHVTEGPARAPHRSYLYAMGLSEDEIHQPLVGVATCWNEAAPCNIALNRQAQSVKMGVKQAMGTPREFTTITVTDGIAMGHEGMRSSLASREAIADTVELTMRGHCYDAIVGLAGCDKSLPGMMMAMIRLNTPSVFVYGGSILPGRYEGRDVTVQDVFEAVGQHQAGNLSSCELEKLEAVACPSAGACGGQFTANTMACVSEAIGLALPNSAGAPAPYESRDQFCEASGRAVMNLIAKNIRARDIVTRKSLENAARVVACTGGSTNAGLHLPAMAHEAGIDFYLDDVCDIFRETPYFVDLKPGGNYVAKDLYEVGGVPVIMRELRKAGLIHEDCMTATGRTMGEEIDLVDREADGKVIYPVDAPLTKTGGVVGLKGNLAPEGAIVKVAGIPSQHQVFSGPAHVFECEQDAFEAVQNRDYKEGEVFVIRNEGPSGGPGMREMLATTAALSGQGMGKKIALITDGRFSGATRGFCVGHVGPEAAHGGPIALVENGDIITINAIEGEISVNLTDDELAERKTNWKGPRETIYASGALWKYSQQVGEVYKGAVTHPGGKAEKHVYMDL

SEQ ID NO: 91 - DNA, 1734 bp, Paracoccus denitrificans
atgaaaaacagccgcttcgacaagtcgtccctgcccagccgccatgtgaccgaagggccggcccgcgcgccgcatcgcagctatttctatgccatgggcatatcggaggaagaaatccattccccctgggtgggcgtcgccacctgctggaacgaggccgcgccctgcaacatcgcgctggcccgacaggcgcaatcggtcaagcagggcgtcaagaagggtggcggctgcccgcgcgaattcaccaccatcaccgtcaccgacggtattgccatgggacatgaggggatgcgctccagcctcgcctcgcgcgatgccatcgccgatacggtcgagctgaccatgcgcgggcattgctacgacgcgctggtcgggctggcgggctgcgacaagtcgctgccgggcatgatgatggccatggtgcggctgaacgtgcccagcgtcttcatctatggcggctcgatcctgccgggcaagctcaacggccgcgacgtggtggtgcaggacgtgttcgaggcggtgggccagcacgcggccggcaacatgtccgatgccgagctggagatcctggagcgcgtggcctgcccctcggccggggcctgcggcgggcaatataccgcgaacaccatggcttgcgtgtcggaagccatcgggctggcgctgatgaacagctcgggcgcgccggcgccttacgaatcgcgcgaccagtatgggctggcctcgggcgaggcggtgatggcgctgatcgaaaggaacatccgtgcccgcgacgtggtgacgcgcaaatcgctggaaaacgcggcgcgggtggtggcctgcaccggcggctcgaccaatgccgggttgcacctgcccgccatcgcgcatgaggcggggatcgaattcgacctgttcgacgtctgcgagatcttccgcgacacgccctatttcgtgaacctgcgcccgggcggcgattacgtcgccaaggacttgttcgaggccgggggcgtcccggtcgtcatgcgcgaattgcgccgcgccgggctgatccacgaggattgcctgaccgcctcgggccgcagcatgggcgaggagctggacctggtcaagcgcgaggccgacggcaaggtgatccatccggtgacggcgccgctgtccaggaccggcggcgtggtcgggctgcgcggcaacctggcgcccgacggcgccatcgtgaaggtcgcgggaatggcgcccgagcaccaggtctttaccggccccgcccgggtcttcgaatgcgaggaagaggcgttcgaggccgtcgcccgccgcgattacagcgagggctgcgtgatcgtcatccgaaacgaggggccggccggcggccccggcatgcgcgagatgctggcgaccacggcggcgctgtcggggcagggcatgggcaagaaggtggcgctgatcaccgacgggcggttctcgggcgcgacgcgcggcttctgcgtcggccatgtcggtcccgaggcggcgcatggcggccccatcgccctgctgcgcgacggcgacatgatcaccatcgacgcgatcaggggcgagatctcggtggcgctgccggacgaggaactgacgcggcgccgcgccgcatgggcgggaccgcgcaagaccgactatgcctcgggcgcgctgtggaaatacgcccagttggtcggcaaggcgcgctatggcgcggtcacccatccgggcgcggcggccgaaacccatgtctatatggatcagtga

SEQ ID NO: 92 - protein, 577 aa, Paracoccus denitrificans
MKNSRFDKSSLPSRHVTEGPARAPHRSYFYAMGISEEEIHSPWVGVATCWNEAAPCNIALARQAQSVKQGVKKGGGCPREFTTITVTDGIAMGHEGMRSSLASRDAIADTVELTMRGHCYDALVGLAGCDKSLPGMMMAMVRLNVPSVFIYGGSILPGKLNGRDVVVQDVFEAVGQHAAGNMSDAELEILERVACPSAGACGGQYTANTMACVSEAIGLALMNSSGAPAPYESRDQYGLASGEAVMALIERNIRARDVVTRKSLENAARVVACTGGSTNAGLHLPAIAHEAGIEFDLFDVCEIFRDTPYFVNLRPGGDYVAKDLFEAGGVPVVMRELRRAGLIHEDCLTASGRSMGEELDLVKREADGKVIHPVTAPLSRTGGVVGLRGNLAPDGAIVKVAGMAPEHQVFTGPARVFECEEEAFEAVARRDYSEGCVIVIRNEGPAGGPGMREMLATTAALSGQGMGKKVALITDGRFSGATRGFCVGHVGPEAAHGGPIALLRDGDMITIDAIRGEISVALPDEELTRRRAAWAGPRKTDYASGALWKYAQLVGKARYGAVTHPGAAAETHVYMDQ

SEQ ID NO: 93 - DNA, 1767 bp, Oceanibulbus indolifex
atgtccaccaccccacgcttcgacaaatcccggctgcccagccgccacgtgaccgaaggcccggcccgcgcgccgcatcggtcttactactatgccatgggcatgaccgagcaagagattcaccagccgctggtgggcgtcgccacctgctggaacgaagcagcgccctgcaacatcgcgctgagccgtcaggcgcaggccgtgaagatcggtgtgcattccgaacagggcacgccgcgcgagtttaccacgatcaccgtcaccgatggtatcgcgatgggccacgagggcatgcgctcctcgctcgcgtcgcgcgaagcgattgccgacacggttgagctgaccatgcgcggccactgctatgacgccatcgtgggcctcgcgggctgcgacaaatctctgccggggatgatgatggcgatgctgcggttgaacgtgccgtcggtcttcctctatggcgggtcaatcctgccgggcaaagcacctgccggggccgatgtgcccgaggatttcgccagccgcgatctgaccgtgcaggacatgttcgaagcggtgggccggttccagaacggcaccatgtcgcaagcagccctcgacgtgcttgagcgcgtggcttgcccatcggcgggcgcttgtggcggccagttcaccgccaatacaatggcctgcgtctccgaggcgatcggcctcgcgctgcccaactcgtccggcatgcccgcgccctatgagagccgcgacgcctatgccgaggcctctggcgcggcggtgatgaacctgatcgaaaagaacatccgcgcccgcgacatctgcacccgcgaagcctttgaaaacgcagcgcgcatcgtggcctgcaccggcggctcgaccaacgcgggcctgcacctgcccgccatggcgcatgaagccgggatcgagttctacctcgaagacgtttgcgaaatcttccgcgacacaccctatttcgtcgatatgaaaccgggcggcgcttatgtggccaaagatctttacgatgcgggcggcgtgccggtggtgatgaatgagttgcgcaaagcgggcctcattcacgaagactgcatgactgccaccggctactccatgggcgaagtgctcgatcaggttacccgcgaagcagacggcaaggtgatccactcggtcgccaatccgatcagcaagaccggcggtgtcgtgggcctcaaaggcaacctcgcccccgaaggtgccatcgtgaaaatcgcgggcatgtctgacgaagacatcgtcttcaccggcccggcactggtgttcgaatgtgagcaagacgctttcgaagccgtgcaaaaccgcgcctattccgaaggcgacgttttcgtcatccgcaacgaaggccccgcaggcggccccggcatgcgcgagatgctggccaccaccgccgcgctttcgggtcaaggcatgggcaagaaggtggcgctgatcaccgatggccgcttctcgggtgcgacacgtggcttctgtgtgggtcacgttggccccgaagcggcgcatggcggaccgattgcgctgctgaaaaacggcgacatgatcacccttgatgcgatcaaaggttccatcagcgtcgacctgagcgatgatgagcttgccgagcgccgcaagggctgggctggcccgcgtgccacaaactaccaaagcggcgcgctgtggaaatacgccaaacttgtcggccctacctaccttggtgccgtgacacatccgggcgctcaggccgagacccatgattacatggacctctaa

SEQ ID NO: 94 - protein, 588 aa, Oceanibulbus indolifex
MSTTPRFDKSRLPSRHVTEGPARAPHRSYYYAMGMTEQEIHQPLVGVATCWNEAAPCNIALSRQAQAVKIGVHSEQGTPREFTTITVTDGIAMGHEGMRSSLASREAIADTVELTMRGHCYDAIVGLAGCDKSLPGMMMAMLRLNVPSVFLYGGSILPGKAPAGADVPEDFASRDLTVQDMFEAVGRFQNGTMSQAALDVLERVACPSAGACGGQFTANTMACVSEAIGLALPNSSGMPAPYESRDAYAEASGAAVMNLIEKNIRARDICTREAFENAARIVACTGGSTNAGLHLPAMAHEAGIEFYLEDVCEIFRDTPYFVDMKPGGAYVAKDLYDAGGVPVVMNELRKAGLIHEDCMTATGYSMGEVLDQVTREADGKVIHSVANPISKTGGVVGLKGNLAPEGAIVKIAGMSDEDIVFTGPALVFECEQDAFEAVQNRAYSEGDVFVIRNEGPAGGPGMREMLATTAALSGQGMGKKVALITDGRFSGATRGFCVGHVGPEAAHGGPIALLKNGDMITLDAIKGSISVDLSDDELAERRKGWAGPRATNYQSGALWKYAKLVGPTYLGAVTHPGAQAETHDYMDL

SEQ ID NO: 95 - DNA, 1767 bp, Sulfitobacter sp.
atgtccaccaacacccgctttgataaatccagactgccaagccggcacgtgaccgaggggccagagcgcgcaccgcaccggtcctattactacgcaatgggcatgaccgaagaagagattcaccagcctctggtgggtgtggcaacctgctggaacgaagcggccccctgtaacatcgcgctgaaccgtcaggcccaagcggtcaaggtcggcgtcaaggcgcagcaaggcacgccacgcgaattcaccaccatcactgtcaccgacgggatcgccatgggccacgagggcatgcgctcttccctagcgtcgcgcgaagcgattgccgacacggtagagctgacaatgcgcggtcactgctacgatgcgattgtcggtcttgcgggctgtgacaaatcgctgccgggcatgatgatggcgatgctgcggctgaacgtgccgtccgtgttcctctacggtgggtcgatcctgccgggcaaagtcccggaaggggccgatgtgcctgccgatttcgccagccgcgatctgactgtgcaagacgttttcgaagccgtgggtaactaccagaacggcagcatgtcgcaagccgcgcttgaagtattggagcgcgtcgcttgcccgacagccggtgcctgcgggggccagttcaccgccaacactatggcctgcgtgtccgaggcaattggtctggcgctgctgaactcctctggcatgcctgcgccctatgaatcccgcgacgcctatgcggcggcctcgggtgaagccgtcatgaacctgatcgaaaagaacatccgcgcgcgcgacatctgcacccgcgaagcgttcgagaatgcggcgcgtatcgtggcctgcaccggcgggtcgaccaatgccggtctgcacctgcccgctatggccgccgaggcgggtatcgactttaacctcagcgatgtgtgcgacatcttccgcgacacgccttatttcgtcgacatgaaacccggcgggtcgcatgtggcaaaagacctgtatgacgcgggcggcgtgcctgttgtgatgaaagaactgcgcaaggctggcctgctgcatgatgactgtctcaccgcctcgggcctgtccatcggtgaagagctcgacaagatcgaacgcgaagccgacggcaaggtgatccacgcgatcgaaacaccgatcagcaagaccggcggcgtcgttggtctgaagggcaacttggcacccgaaggggccatcgtgaaaatcgcgggcatgtccgaagaagacatcgtctttaccggtccggcgctgatctttgaatgtgaacaggatgcgttcgaagccgtgcaaaaccgggcctacagcgaaggcgacgtgttcgtgatccgcaacgaaggccccgctggtggccccggcatgcgcgaaatgctggcgaccacggcggccctgtccggtcaaggcatgggcaaaaaggtggcactgatcaccgacggccgtttctccggcgcgacacggggtttctgcgttggtcacgtcggccccgaagccgcacatggcggaccgattgccttgctcaaacagggtgacatgatcacactgaacgcgatcaccggttcgatctctgtcgatatctcggacgaggaaatggcagaacgcaaagcggcttggcccggtgcccgcaaaacaaactatcaaagcggtgcactgtggaaatacgcgcagcttgtgggcccaacctatcttggtgcggtgacgcatcccggcgcgaaggcggaaacacatgactatatggacctgtaa

SEQ ID NO: 96 - protein, 588 aa, Sulfitobacter sp.
MSTNTRFDKSRLPSRHVTEGPERAPHRSYYYAMGMTEEEIHQPLVGVATCWNEAAPCNIALNRQAQAVKVGVKAQQGTPREFTTITVTDGIAMGHEGMRSSLASREAIADTVELTMRGHCYDAIVGLAGCDKSLPGMMMAMLRLNVPSVFLYGGSILPGKVPEGADVPADFASRDLTVQDVFEAVGNYQNGSMSQAALEVLERVACPTAGACGGQFTANTMACVSEAIGLALLNSSGMPAPYESRDAYAAASGEAVMNLIEKNIRARDICTREAFENAARIVACTGGSTNAGLHLPAMAAEAGIDFNLSDVCDIFRDTPYFVDMKPGGSHVAKDLYDAGGVPVVMKELRKAGLLHDDCLTASGLSIGEELDKIEREADGKVIHAIETPISKTGGVVGLKGNLAPEGAIVKIAGMSEEDIVFTGPALIFECEQDAFEAVQNRAYSEGDVFVIRNEGPAGGPGMREMLATTAALSGQGMGKKVALITDGRFSGATRGFCVGHVGPEAAHGGPIALLKQGDMITLNAITGSISVDISDEEMAERKAAWPGARKTNYQSGALWKYAQLVGPTYLGAVTHPGAKAETHDYMDL

SEQ ID NO: 97 - DNA, 1764 bp, Roseobacter denitrificans
atgtccagccagcgctttgataaatccaagctgcccagccgccatgtgaccgagggaccctcacgggcgccgcatcggtcctactattacgcgatgggcatgacggaggaagaaatccatcaaccgcttgttggcgtggccacttgctggaacgaggccgccccctgcaacatcgcgctgaaccgccaggcgcaatcggtcaagatgggcgtgaaacgcgaaagcggcacgccacgtgaattcaccaccatcaccgtcaccgacggcatcgcgatgggccacgagggcatgcggtcgtcactggcgtcacgcgaggcaattgccgatacggtggaactgaccatgcgcgggcattgctatgacgcacttgtggggctggcgggctgcgacaaatccctgccgggcatgatgatggcgatgatccgtctgaatgtgccatcggttttcctttatggcgggtcaatcctgccgggacgtgcgcccaagggggcgtcggtgcctgccgaatacgccgaccgcgacctgaccgttcaggacatgttcgaagctgttgggcatcaacagaacggcaccctgagcgaggcagaactcgaagtgctcgaacgcgtcgcctgcccttctgccggggcttgtggcgggcagtttaccgccaacaccatggcctgtgtatccgaggccatcggtctggcgttgcccaattccgccggggcacctgcgccgtacgaatcccgcgacgcctatgccgaagcctcgggtgcggcggtcatgaacctgatcgaaaagaacatccgtgcgcgcgacatctgcacgcgggaggccttcgagaatgccgcgcgcatcgtcgcttgtacgggcgggtcgaccaacgccggtctgcacctgcctgccatggcgcatgaagcgggcatcgatttcttcctcgaagacgtctgcgagatcttccgcgacacgccctatttcgtcgatctgaaaccgggcgggcagtatgtcgccaaggacatgtacgaagccggcggcgtgcccgtggtaatgaaagagctgcgcaaggcaggcctgttgcacgaggactgcatgaccgtcaccggctattccatcggcgaggaactggacaaggtcagccttgaggcggatggccgagttgtctatccgattgaaacaccgctgtcgaaaaccggtggcgtcgtcggcctcaagggcaaccttgcccccgaaggagccatcgtgaaaatcgccggaatggagccgcagcatttgctgttcaccggccctgcgcgaatctttgagtgtgagcaggacgcgtttgaagccgtccagaaccgcacctacaaagagggcgatgtctttgtcatccgcaacgagggccctgctggcggccccggcatgcgcgagatgctggcaacgacggcggcgctttcgggtcagggcatgggcaagaaagtcgcgctgatcacggatggacgtttctcgggggcgacacgcgggttctgcgtcggccatgtgggtcccgaggccgcgcacggaggccccatcgccttgctcaaggatggcgatatgatcacgcttaacgcgatcgaggggaccatcaccgtcgatgtgtccgacgaggagatggccgagcgtaaagccaattggaaaggggcgcgtccaacgatctatggtgctggtgccttgtggaaatacgcgcaacttgtggggccaacctatctcggggccgtgacccatccgggcggtaaagacgaaggccacgcgtacatggaactgtaa

SEQ ID NO: 98 - protein, 587 aa, Roseobacter denitrificans
MSSQRFDKSKLPSRHVTEGPSRAPHRSYYYAMGMTEEEIHQPLVGVATCWNEAAPCNIALNRQAQSVKMGVKRESGTPREFTTITVTDGIAMGHEGMRSSLASREAIADTVELTMRGHCYDALVGLAGCDKSLPGMMMAMIRLNVPSVFLYGGSILPGRAPKGASVPAEYADRDLTVQDMFEAVGHQQNGTLSEAELEVLERVACPSAGACGGQFTANTMACVSEAIGLALPNSAGAPAPYESRDAYAEASGAAVMNLIEKNIRARDICTREAFENAARIVACTGGSTNAGLHLPAMAHEAGIDFFLEDVCEIFRDTPYFVDLKPGGQYVAKDMYEAGGVPVVMKELRKAGLLHEDCMTVTGYSIGEELDKVSLEADGRVVYPIETPLSKTGGVVGLKGNLAPEGAIVKIAGMEPQHLLFTGPARIFECEQDAFEAVQNRTYKEGDVFVIRNEGPAGGPGMREMLATTAALSGQGMGKKVALITDGRFSGATRGFCVGHVGPEAAHGGPIALLKDGDMITLNAIEGTITVDVSDEEMAERKANWKGARPTIYGAGALWKYAQLVGPTYLGAVTHPGGKDEGHAYMEL

SEQ ID NO: 99 - DNA, 1764 bp, Jannaschia sp.
atgaccgccaacaggccagacaaatccagattgcccagtcgccatgtgaccgaaggacccgagcgcgcgccgcatcggtcgtatttctacgccatggacctgacacaggagcagatcgaccagccattcgtcggcgtcgccacctgctggaacgaagcggccccttgcaacatcgcgctcaactggcaggcgcaatcggtgaaacgcggtgtgggtgaggcgaacggtacgccgagggaattcaccacgatcaccgtcaccgacggcattgcgatggggcatgaagggatgcggtcctcgctggcgtcgcgcgatgcgatcaccgacacggtggaactgacgatgcgcggccactgctatgacgcattggtcgggcttgccgggtgcgacaagtccctgcccggcatgatgatggccatggtgcgcctgaacgtgccgtccgtcttcatctatggcggcacgatccttcccggcaaagcgcctgaagttgccgacattcccgccgagtttgccaaccgtgacctgaccgtgcaggacatgttcgaggccgtgggcaagtaccagtccggccaattgagcgaagccgccctggaagttctggaacgcgttgcctgcccgtctgcgggcgcctgtggcggtcagttcaccgccaacaccatggcatgtgtgtccgaggcgattggtctggcaatgctcaactcctccgggatgcctgcgccttacgaggggcggaaggaattcggcgaggcaagcggtcgcgcggtgatgaacctgcttgaaaagaacatccgcgcccgtgacgtcgtcacccgcaaagcgttggagaatgcggcccgtgttgtggcgtgtaccgggggctccaccaatgcaggtctgcaccttcccgcgattgcccatgaggccggaatcgacttcgacctctttgacgtctgcgacatcttcaaggacacgccctacttcgtcgacatgaaacccggcggtcagtatgtggcgaaagacctctatgaggtgggcggcgtgccagtcgtgatgaaggagctgttgaaagaggggctgttgcacggcgattgcctcactgcctctggcgagacgatggaagaggcgctcgacaagatccagggcacgcccgatggccgtgtggtccatacggtccagaacccgatcaccagcaccggcggcgtggtcggcctgcgcggcaatctcgccgaagagggtgcgatcgtgaaagttgcgggcatggatgaggcaagccaggtcttcaccggacccgcgcgcgtgtttgaatgcgaagaagacgcctttgccgccgtgaaggcgcgcggctacgaggaaggcgaagtcattgtcatccgcaatgaagggccaaagggcggcccgggcatgcgggaaatgttggcgacgacggcggcattgtcgggtcagggcatgggcaagaaggtggccctgatcaccgacggccggttctctggtgcaacgcggggcttctgcgtcggtcacgtgggacctgaggcggctgttggcggaccgattggtctgctggagaacagcgacatgatcaccatcaatgcgctgacgggggaactgtcggttgccttgaccgaggcggaattggccgagcgtcggaaggcctgggccggtccgcgtgagacaatgtacgcctctggcgcgttgtggaaatacgcgcaattggtgggagaggcgcgctatggcgcggtgacccatcccggcggggccaaggaaaagcacgtctatgcggacatctag

SEQ ID NO: 100 - protein, 587 aa, Jannaschia sp.
MTANRPDKSRLPSRHVTEGPERAPHRSYFYAMDLTQEQIDQPFVGVATCWNEAAPCNIALNWQAQSVKRGVGEANGTPREFTTITVTDGIAMGHEGMRSSLASRDAITDTVELTMRGHCYDALVGLAGCDKSLPGMMMAMVRLNVPSVFIYGGTILPGKAPEVADIPAEFANRDLTVQDMFEAVGKYQSGQLSEAALEVLERVACPSAGACGGQFTANTMACVSEAIGLAMLNSSGMPAPYEGRKEFGEASGRAVMNLLEKNIRARDVVTRKALENAARVVACTGGSTNAGLHLPAIAHEAGIDFDLFDVCDIFKDTPYFVDMKPGGQYVAKDLYEVGGVPVVMKELLKEGLLHGDCLTASGETMEEALDKIQGTPDGRVVHTVQNPITSTGGVVGLRGNLAEEGAIVKVAGMDEASQVFTGPARVFECEEDAFAAVKARGYEEGEVIVIRNEGPKGGPGMREMLATTAALSGQGMGKKVALITDGRFSGATRGFCVGHVGPEAAVGGPIGLLENSDMITINALTGELSVALTEAELAERRKAWAGPRETMYASGALWKYAQLVGEARYGAVTHPGGAKEKHVYADI

SEQ ID NO: 101 - DNA, 1731 bp, Caulobacter sp.
atgaccaagaaacccgacgggacctgggacaagtcgcaactgcccagccggcatgtaaccgaagggccggcccgcgcgccgcaccgctcttattattacgccatgggtcttggcacgcgtgagatcgcccagccgttcgtcggcgtcgcctcgtgctggaacgaggccgcgccctgcaacaccgccctgatgcgccaggccaacgccgtggccaagggcgtcaaggcggccggcggcaccccgcgcgagttctgcaccatcaccgtcaccgacggcatcgccatgggccacgagggcatgcgttcgtccctggtcagccgcgacgtgatcgccgactccgtcgagctgaccatgcgcggccacggctatgacgcgctcgtgggcgtcgccgggtgcgacaagagcctgccgggcatgatgatggccatgctgcgcctcaacgtgcccagcgtgttcctgtacggcggctcgatcctcccgggacgcttccagggccgcgacatcaccgtgatggacgtcttcgagggcgtcggcgcctatgccgccgggaccatggacgccaagaccctgtgcgagctggagcagcacgcctgcccgtcggacggcgcctgcggcggccagttcacggccaacaccatggcctgcgtgtcggaagccatcggcctggccctgccgctgtcctcggccctgccggccccgtacctggaccgcgaccagtacgcggtggcctcgggcgaggcggtgatgcggctgatcgagcagaacatccgcccgcgcgatatctgcacccgcaaggccttcgagaacgccgccgtcgtcgtcgcggccaccggcggttcgaccaatggcgcgctgcacctgccggccatggcccacgagtgcggcatcgagttcaccctcaaggacgtggccgagatcgccgcccgcacgccctatatcgccgacctcaagcccggcggtcgctacgtggccaaggacatgggcgaggccggcggcgtgccgatgctgctgcgcaccctgctggacgccggcctgctgcacggcgacgtcatgaccgtcaccggcaagaccctggccgagaacctggccgatgtggtctggcgtgaggaccaggacgtgatccgcccggtctccaatccgctgtcgccgactggcggcgtggtcggcctgtggggctcgctggcgcccgagggcggcatcgtcaaggtggccggcctcaagcaccaggtgcaccgcggcccggcccgggtgttcgacggcgaggcggcctgtttcgaagcggtgtcgaaccgcgactacaaggcaggcgacgtcctggtcatccgctacgaaggtccgcgcggcgggccgggcatgcgcgagatgctgtcgacgaccgccgcgatctacggccagggcgtggagaacatcgccctgatcaccgacggccgcttctcgggcgccacgcgcggcctgtgcatcggccacgtgggtcccgaggccgccgtgggcggtccgatcgccctggtgcaggacggcgacatcatcagcatcgacgccaccaaggggacgatcgagcttgaggtcgaggccgaggaactggcgcgccgcaaggccgcctggaagccgcgcggccacgactacaacagcggcgcgatctggaagttcgcccaactggtcggtccagcctatcttggcgccacgacccatccgggcgcggccaaggagacgcacgtctacgcggacatctga

SEQ ID NO: 102 - protein, 576 aa, Caulobacter sp.
MTKKPDGTWDKSQLPSRHVTEGPARAPHRSYYYAMGLGTREIAQPFVGVASCWNEAAPCNTALMRQANAVAKGVKAAGGTPREFCTITVTDGIAMGHEGMRSSLVSRDVIADSVELTMRGHGYDALVGVAGCDKSLPGMMMAMLRLNVPSVFLYGGSILPGRFQGRDITVMDVFEGVGAYAAGTMDAKTLCELEQHACPSDGACGGQFTANTMACVSEAIGLALPLSSALPAPYLDRDQYAVASGEAVMRLIEQNIRPRDICTRKAFENAAVVVAATGGSTNGALHLPAMAHECGIEFTLKDVAEIAARTPYIADLKPGGRYVAKDMGEAGGVPMLLRTLLDAGLLHGDVMTVTGKTLAENLADVVWREDQDVIRPVSNPLSPTGGVVGLWGSLAPEGGIVKVAGLKHQVHRGPARVFDGEAACFEAVSNRDYKAGDVLVIRYEGPRGGPGMREMLSTTAAIYGQGVENIALITDGRFSGATRGLCIGHVGPEAAVGGPIALVQDGDIISIDATKGTIELEVEAEELARRKAAWKPRGHDYNSGAIWKFAQLVGPAYLGATTHPGAAKETHVYADI

SEQ ID NO: 103 - DNA, 1719 bp, Candidatus Pelagibacter ubique
atggcaaaatttaataaaaaaaaattaccaagcagacatacttcattaggtgctgatagagctccacatagatcattttactatgcaatgggtgaaacagaaaaagatgtagcaaagccatttgttggtgttgtgtcaacttggaatgaagctgctccttgtaatattgctttaatgagacaagctcaatctgtcaaaaaaggcgttagagcttcaggtggaacccctagagaattttgtacgataacagtaactgatggtattgccatgggtcacgaaggaatgaagtcatctttaatctctcgcgaggtaattgctgattcaactgaacttactgtgcgtggtcattgttatgatgcgcttgttggtattgctggttgtgataaatctttacctgccttaatgatggcaatggttagattaaatgttccaagtgtatttatttatggtggctcaatacttccaggtcaatataaaggtaaagatgtaactgttgttgatgtttttgaagcagttggaaaacactcagctggaaaaatgtctgcaaaggaattaagaaaattagagttagttgcttgcccaagtgcaggtgcatgtggaggtcaatttactgcaaatactatggcctgcgtttctgaagctattggtttagcattaccttattcagctggaacacctgctccatacgaagaacgtgataagtatgcattattaagtggcaagactgtaatgaatttattacaaaaaaatattcgtccaagagacattgttacaaaaaaatctttagaaaatgctgcaacaattgtagcggctactggtggatcgacaaatgctgctttacacctaccagctatagctaatgaaattggaattaagtttgatttaatggatgtagctaaaatttttaaaaaaactccatatcttgcagatttaaaaccaggtggaaaatatgttgcaaaagatatgtggttagctggtggagtacctatgttattaaaaactctttttgatggtggttttatacatggtgattgcatgactgttactggaaaaacaatgaaacaaaatttaaaaaatattaaatttaatcctaagcaaaaagtattaagagcatatgataatcctttatcaccagatggcggtgttgtaggtcttaaaggtaacttagctcctgatggtggaattgttaaaattgctggtttaaaaaaattacaattcactggaaaagctagatgttttgataatgaagaagcagcaatggcttgtgtgcaaaagaaaaaatataaagcaggtgatgtaattattattcgttacgaaggaccagttggcggtcctggtatgagagaaatgctttcaacaacaggtgctatttatggtcaaggtatgggtgagaaggttgctctaattacagatggtagattttctggggctacaagaggtttttgtgtgggtcatgttggccctgaggcggccttaggcggccctttagctcttttacgcaatggagatgtaattgatatagatgccaaaaaagggactattaacgttagattaactaaatcacaattagccacaagacataagaagtggaaagcaaaaaaatcaagctttggatcgggtactatttggaaatatgctcaaacagtaggtcccgcttatttaggtgcaccaacacatcccggtaaaagaaaagaagtaaaagtttacgctgatatttaa

SEQ ID NO: 104 - protein, 572 aa, Candidatus Pelagibacter ubique
MAKFNKKKLPSRHTSLGADRAPHRSFYYAMGETEKDVAKPFVGVVSTWNEAAPCNIALMRQAQSVKKGVRASGGTPREFCTITVTDGIAMGHEGMKSSLISREVIADSTELTVRGHCYDALVGIAGCDKSLPALMMAMVRLNVPSVFIYGGSILPGQYKGKDVTVVDVFEAVGKHSAGKMSAKELRKLELVACPSAGACGGQFTANTMACVSEAIGLALPYSAGTPAPYEERDKYALLSGKTVMNLLQKNIRPRDIVTKKSLENAATIVAATGGSTNAALHLPAIANEIGIKFDLMDVAKIFKKTPYLADLKPGGKYVAKDMWLAGGVPMLLKTLFDGGFIHGDCMTVTGKTMKQNLKNIKFNPKQKVLRAYDNPLSPDGGVVGLKGNLAPDGGIVKIAGLKKLQFTGKARCFDNEEAAMACVQKKKYKAGDVIIIRYEGPVGGPGMREMLSTTGAIYGQGMGEKVALITDGRFSGATRGFCVGHVGPEAALGGPLALLRNGDVIDIDAKKGTINVRLTKSQLATRHKKWKAKKSSFGSGTIWKYAQTVGPAYLGAPTHPGKRKEVKVYADI

SEQ ID NO: 105 - DNA, 1722 bp, Erythrobacter litoralis
atgtcgtcgagattcgacaagtccaagctgcccagccgccacgtttcggtcgggccagagcgcgcgccgcatcgttcgtattactacgcgatgggtctgaccgagcaggagatcgcgcgacccttcgtcggcattgttagcgcgggcaacgacagcgcgccctgcaacacgacgctcgatgcgcaggcggacatctgtcgcactggcgtcaaccaagcaggcggcatgccgcggcgcttcaacaccatcaccgtgacggacggtatcgccatgggacaccagggcatgaaaagctcgctggtcagccgcgaggtgattgcggactcgatcgagctatcggtgcgcgggcattgctatgatgcgctggtcggattcgccggctgcgacaagagcttgcccggcatgatgatggccatgctgcggctcaatgttccgagcatcttcgtctatggcggatcgatcctgccgggccgcttccacgacaaggacgtgaccgtcgtcgacgtgttcgaagcggtcggccagcacgcggcgggcaattgtccgctgaaagaactgaccgcgctggaaaaggtcgcctgtcccgggcacggcgcgtgcggcgggcagtttaccgccaacaccatggcctgcgtcggcgaagcgatcggcctgtcgctgcccaacagcaatatggcccccgcgccctatcgttcgcgcgaggagatcgcggtggcggcggggcggcaggtcatgacgctgctggagaaaaacctgcgcccgcgtgacatctgcacaagggccgcattcgagaatgcagcacgggtcgtcgcggcaacgggcggctcgaccaatgccgctttgcacctgcctgccatggcccatgaatgcggcatcgacttcgacctgttcgatgtcgccgagacattcaaatcaacaccttatatcgcagacctcaaacctggcgggcgctatgtcgccaaggacatgcacgaggcgggcggggtctacatggcgatgaaaacgctgctggagggcggtttcctcgatcccgaaccgatgaccgtcacaggcaagacgctgggcgagaatatcgaggagatcacctgggaccccgaccagaaggttttctacgacgtatccaatccgatcacgccgaccggcggcgtcgtcgggctcaggggttctctcgcgcccgacggggcgattgtgaaggtggcgggaatggaacggctccagttcagcggcccagcgcgagtattcgattgcgaggaggatgccttcaaggcggtcgagcagcgcgacatcgccgaaggttgcgtcatcgtaatccgctacgaaggccccaagggcggccccggcatgcgcgaaatgctctctactaccgcagcgctctacgggcagggcatgggcgagaaagtggcgctcatcaccgacgggcgcttctccggcgcgacgcgcggcttttgcatcggccatgtcggcccggaagcggcagactgcggcccgattgcgctggtcgaggatggcgatacaatcagcatcgatgccgttgcaggcacgattgagctcgacgtcgatgccgaaacgcttgaaaaacggcgtcaaagctggacaccgcgggcgaacgattaccagtccggcgcgctgtggcgctatgcgaggaacgtcggtcctgcgcatgagggcgcagtgactcatccgggagcgaaatcggaacgccatgtctttgcggatatctag

SEQ ID NO: 106 - protein, 573 aa, Erythrobacter litoralis
MSSRFDKSKLPSRHVSVGPERAPHRSYYYAMGLTEQEIARPFVGIVSAGNDSAPCNTTLDAQADICRTGVNQAGGMPRRFNTITVTDGIAMGHQGMKSSLVSREVIADSIELSVRGHCYDALVGFAGCDKSLPGMMMAMLRLNVPSIFVYGGSILPGRFHDKDVTVVDVFEAVGQHAAGNCPLKELTALEKVACPGHGACGGQFTANTMACVGEAIGLSLPNSNMAPAPYRSREEIAVAAGRQVMTLLEKNLRPRDICTRAAFENAARVVAATGGSTNAALHLPAMAHECGIDFDLFDVAETFKSTPYIADLKPGGRYVAKDMHEAGGVYMAMKTLLEGGFLDPEPMTVTGKTLGENIEEITWDPDQKVFYDVSNPITPTGGVVGLRGSLAPDGAIVKVAGMERLQFSGPARVFDCEEDAFKAVEQRDIAEGCVIVIRYEGPKGGPGMREMLSTTAALYGQGMGEKVALITDGRFSGATRGFCIGHVGPEAADCGPIALVEDGDTISIDAVAGTIELDVDAETLEKRRQSWTPRANDYQSGALWRYARNVGPAHEGAVTHPGAKSERHVFADI

SEQ ID NO: 107 - DNA, 1716 bp, Erythrobacter sp.
atgtccttcgataagtccaagttgccaagccgccatgtctcggtcgggcctgaacgcgcgccccaccgttcctactattacgcgatgggcatgaccgaggaagaaatcgcacgccccttcgtcgctgtggccagtgctggtaacgattccgcgccgtgcaacacaacgctcgatccgcaggcgaatatctgtcgcgaaggcgtcattgcggggggagggaccccgcgccgcttcaacaccatcacggttacggacgggatcgcgatgggccatcagggcatgaagagctcgctggtaagtcgcgaggtcattgcggactccgtcgagctttcggtgcgcggtcattgttacgatgcgcttgtaggatttgccggatgcgacaaaagcctgcccgggatgatgatggccatgctgcggctgaacgtgccgagcatctttgtctatggcggctcgatcctcccaggcactcatcgcggcaaggacgtgacggtcgtcgatgtgttcgaagccgtgggccagcatgctgccgggaattgcccgcttcaggagttgatcgagctcgaaaaggttgcctgtcccggacacggagcctgtggcggccagttcacagccaatacgatggcctgcgtgggtgaggcaatcggattgtcattgccgaacagcaacatggctcctgctccttacagatcgcgtgaagaaatcgctcgcgccgcgggcgagcaggtgatgatactgcttaagcaaaatctgcgcccacgcgacatctgcacgcgcgcggcctttgaaaacgcggcccgcgttgtcgccgcaaccggcggttctaccaatgccgctctgcaccttcctgccatggcgagcgaatgcgggattgatttcgatcttttcgacgttgcggagatcttcaaatcgacaccctacatcgccgacctgaagcccggcggtaagtacgtcgcaaaggacatgcacgaagcgggcggcgtctacatgggcatgaagacactgctcgaaggagggttcctcgatcccgggccgatgactgtgaccggcaagacgctgggcgagaacatcgaggagatcacctggaaccccgatcaaaaggtattctacgacgtaaagaacccgatcaccccgaccggcggtgtggttgggcttaagggctcgctcgcgcccgaaggtgcgatcgtaaaggttgccgggatggaacgtttgcaattcaccggcacggctcgcgtattcgaatgcgaggaagatgccttcgaggcggtcgagaagcgcgacattgtcgaaggcagcgtcatcgtcatccgctacgaaggccccaagggtggacctggaatgcgcgagatgctcgccaccaccgctgcgctttacggccagggtatgggtgagaaagtcgccctcatcacagatgggcggttctcaggcgctacgcgtggtttctgtatcggccatgtcggccctgaagccgcggatggcggaccgatcgctctcgtcgaggatggcgacacgatcagcatcgatgccgagcttggcacgatcgacctggaggtcgaccaaagcgtgcttgaagaacgccgaaaagcatggaagccgcgtacgaacgattatcagtcgggggcgctgtggcgttacgcgcagaatgtcgggtccgcacgaaacggagcgctcactcacccgggcgccaagtctgagacccatgtgtttgcggacatctag

SEQ ID NO: 108 - protein, 571 aa, Erythrobacter sp.
MSFDKSKLPSRHVSVGPERAPHRSYYYAMGMTEEEIARPFVAVASAGNDSAPCNTTLDPQANICREGVIAGGGTPRRFNTITVTDGIAMGHQGMKSSLVSREVIADSVELSVRGHCYDALVGFAGCDKSLPGMMMAMLRLNVPSIFVYGGSILPGTHRGKDVTVVDVFEAVGQHAAGNCPLQELIELEKVACPGHGACGGQFTANTMACVGEAIGLSLPNSNMAPAPYRSREEIARAAGEQVMILLKQNLRPRDICTRAAFENAARVVAATGGSTNAALHLPAMASECGIDFDLFDVAEIFKSTPYIADLKPGGKYVAKDMHEAGGVYMGMKTLLEGGFLDPGPMTVTGKTLGENIEEITWNPDQKVFYDVKNPITPTGGVVGLKGSLAPEGAIVKVAGMERLQFTGTARVFECEEDAFEAVEKRDIVEGSVIVIRYEGPKGGPGMREMLATTAALYGQGMGEKVALITDGRFSGATRGFCIGHVGPEAADGGPIALVEDGDTISIDAELGTIDLEVDQSVLEERRKAWKPRTNDYQSGALWRYAQNVGSARNGALTHPGAKSETHVFADI

SEQ ID NO: 109 - DNA, 1815 bp, Comamonas testosteroni
atgaacgattcccgctccaccgatccccaggccgctgtcagcggccacgctgaaccctccgactcctctgtgtcatcctccgccccgggcctgcgctcggccatcgtgcaccgcggcaccttgcgcgccagcgcgcgcagctttctgcatgcgctgggccaggacgatgaggagattgcacgcccgcatgtgggcgtgttccatacgggcggggagatgagcccctgcaatatgaatctccgcgaccaggcccagcatgccaagaccggcatctacgcgggaggcggcatgccgcacgagtgccccgtggtctcggtcagcgacggcctgaccatggcgcattcgggcatgcgcttttcgctgatctcgcgcgagctcatcgccgacagcgtggaggcctcggtgcgcggccaccagtgggacggtatctttgccgtgggtgcctgcgacaagaacctgccgggcctgatgatggccatggtgcgctgcaatgtgcccagcgtcttcgtgcatggcggctcggccctgcccgggcagatgccgggcagcgtatcggggcgcgcccttaacgtggtcgacacctacgagaccataggcaaggtgctggccggcacttccaccatgcaggagctggacaccgtcacgcgctcctgcctgccctcggccggggcctgtgccgggcagttcacggccaacaccatgggcatggtcagcgaggccctgggcctggcgcccataggctccagcatggtgccggccgtgttcagcgaacgcgcgccgctgatgcgccgcgcgggccgtcagctcatggaaatggtgtgggccagcgccaggggagaggccgtgctgccgcgcgacatcgtcacgcgcaaggccctggaaaatgcctgtgccgtggtctgcgccacgggtggctccacgaatgcggccctgcacctgccggcgatcgcgcacgaggccggcatacgctttcacctcgacgacgtggccgagatctttgcgcgcacgccgctgatcgcagacctcaagcccggcggccgcttcctggcacgtgatgtctactacatcggcggtgcggctgtcatcctgcgcaccctgctggagcagggcctgctgcatggcgatgcactcaccttcacgggccgcacgctggccgaggaggtggccgatgctgccgagcccgacggcgaagtggtgcgcaaggccggcaacccgatctcggccgacggtgggctcacggtgctcaagggcaatctgtgccctgacggtgccctgctcaagacggcggggctcaagaccctggtgcaccgcggtccggcccgcgtcttcgactccgaggaacaggcgcaggacgccgtgcaggccatggcctaccggagcggcgatgtgctggtgatacgcaacgaaggccccaagggcagccccggcatgcgcgagatgctgggcatcactgccttgctctatggccagggcatgggcgacaaggtggcactgctcaccgacgggcgcttctcgggcgccacgcgcggcctgtgcataggctacgcggggccggaggccgctgacggtgggccgattgccgcactgcaggacggcgacatcatcgccatcgatgcgcgggccggcgcgcgcagcatcacggtggagctggagcccgccgtcattgccgcgcggctggaagccgcccgggccagccgtgcgcagcagcgccccctgggcgggctgctggagaaatacgcgctgaccgtgcgtcccgcccaccagggcgcggtcacgcattcgggggcggtgacctggctgcgcgacagcaagtga

SEQ ID NO: 110 - protein, 604 aa, Comamonas testosteroni
MNDSRSTDPQAAVSGHAEPSDSSVSSSAPGLRSAIVHRGTLRASARSFLHALGQDDEEIARPHVGVFHTGGEMSPCNMNLRDQAQHAKTGIYAGGGMPHECPVVSVSDGLTMAHSGMRFSLISRELIADSVEASVRGHQWDGIFAVGACDKNLPGLMMAMVRCNVPSVFVHGGSALPGQMPGSVSGRALNVVDTYETIGKVLAGTSTMQELDTVTRSCLPSAGACAGQFTANTMGMVSEALGLAPIGSSMVPAVFSERAPLMRRAGRQLMEMVWASARGEAVLPRDIVTRKALENACAVVCATGGSTNAALHLPAIAHEAGIRFHLDDVAEIFARTPLIADLKPGGRFLARDVYYIGGAAVILRTLLEQGLLHGDALTFTGRTLAEEVADAAEPDGEVVRKAGNPISADGGLTVLKGNLCPDGALLKTAGLKTLVHRGPARVFDSEEQAQDAVQAMAYRSGDVLVIRNEGPKGSPGMREMLGITALLYGQGMGDKVALLTDGRFSGATRGLCIGYAGPEAADGGPIAALQDGDIIAIDARAGARSITVELEPAVIAARLEAARASRAQQRPLGGLLEKYALTVRPAHQGAVTHSGAVTWLRDSK

SEQ ID NO: 111 - DNA, 1707 bp, Sphingomonas wittichii
atgacgacccgaaaatttcgatccgagatcatccgcgaaggcgtggtccgaacgaccacgcgcagcttcctctacgccctgggcgaggacgacgaggatctgcggcagcctcatgtcgccgtcatccacaccggcggcgagatgagcccgtgcaacaccacgctgcgcgatcaggcgctccacgccaagacgggcatctatgcgggtggcggcacggcgcatgaatgcccggtggtgtcggtgtcggacgggctgtcggtggcgcattcggggatgcgcttctcgctgatctcgcgcgagctgatcgccgacagcgtggaggcgaccgtccggagccatcaatgggatggcgtcctcgcggtcggcggctgcgacaagaacatgcccggcctgatgatgggcatcgtgcgctgcaacgtcccctcggtcttcctctatggtggggcagccctgcccggccatctcggcggccgcgacgtcaacatcgtcgacacctatgagatgatcggccgggtcctggcgggagaggcgacgcaaggggaactggaggacatggcccgcgcctgtcttccgacggcgggagcctgtgccggccaatataccgccaacaccatgggcatggtgtcggaagcgctcggcctggcgctgctgggctcctcgatgatcccggcggtctatgccgcccgggcgccgatggcgcgcaaggcgggcaaggtgctgatgcgagcggtgctcggcggtgggccgctgccgcgcgacatcgtcacccgcaaggcgctggaaaatgcctgcgccgtggtcgccgccaccggcggttcgaccaacgcgccgctgcaccttcccgcgatcgccaacgaagcggggatcgatttcgacctcgacgatgtcgccgcagtgctcgcccgcacgccgctgatcgccgatctcaagcccggcggccgcttcctggccaaggacgtgttcgagatcggcggcaccccggtgatcctgaaggccctgctcgacggcggccatctccatggcgactgcatgacggtcaccgggcggacgctcgccgaagacctcgccaaggtctgcccgccggacggggcggtggtccgcgactgcggcatgccgatcgcgccgtccggcggcgtgaccgtgctcaagggcaatctggccccagacggcgcactgctgaagaccgccggcctgaagaagctcgagcatcgcggccccgcccgcgtcttcgagtccgaggagcaatgcctctccgccgtgcgggcgatggcctatgcggccggcgacgtcatcgtgatccgcaacgaagggccgcgcggcggccccggtatgcgcgagatgctgggcatcaccgcgctgctctacggccagggcatgggggagaaagtcgccctgatcacggacggccgcttctcgggcgcgacccggggcatgtgcatcggctatatctcgcccgaagcggccagtgatggaccgatcggcctggtccgcgacggtgatctcatcgccatcgacgcgcgcgacggcatcgtcagtttgcaggtcgaactgccaaaaggtgagttggaggcgcgtcgcgccctgccccgccccgcccgtgttcgtccgaaaggaggggtcctcgaaaaatatgcggcgatcgttggaccggccaacaagggcgccgtaacccatagcggcaacgtcatatgggagatggatccgtga

SEQ ID NO: 112 - protein, 568 aa, Sphingomonas wittichii
MTTRKFRSEIIREGVVRTTTRSFLYALGEDDEDLRQPHVAVIHTGGEMSPCNTTLRDQALHAKTGIYAGGGTAHECPVVSVSDGLSVAHSGMRFSLISRELIADSVEATVRSHQWDGVLAVGGCDKNMPGLMMGIVRCNVPSVFLYGGAALPGHLGGRDVNIVDTYEMIGRVLAGEATQGELEDMARACLPTAGACAGQYTANTMGMVSEALGLALLGSSMIPAVYAARAPMARKAGKVLMRAVLGGGPLPRDIVTRKALENACAVVAATGGSTNAPLHLPAIANEAGIDFDLDDVAAVLARTPLIADLKPGGRFLAKDVFEIGGTPVILKALLDGGHLHGDCMTVTGRTLAEDLAKVCPPDGAVVRDCGMPIAPSGGVTVLKGNLAPDGALLKTAGLKKLEHRGPARVFESEEQCLSAVRAMAYAAGDVIVIRNEGPRGGPGMREMLGITALLYGQGMGEKVALITDGRFSGATRGMCIGYISPEAASDGPIGLVRDGDLIAIDARDGIVSLQVELPKGELEARRALPRPARVRPKGGVLEKYAAIVGPANKGAVTHSGNVIWEMDP

SEQ ID NO: 113 - DNA, 1767 bp, Burkholderia xenovorans
atgaccaatctgcataaacaccgctcccgcatggtgaccgatggtgtgacgcgtgcgccgcaccgtgcctttctgcgcgcgacaggcctcgacgatgcgtcgatgcaaaagccgttcgtcgcgatcgtcgatacgtttggcgagaacacgccgtgttcgatgtcgctgaaccaggtgtccgataacgcacgtctcggcgttgccgctggcggcggcataccgattcgcggctcggcgatctcggtgtcggacggtacctcgatgaatcattcggggatgcgcatgagccttgtatcgcgcgagatcgtcgcggacagcgtcgagctgttcgtgcgtgcccatgcctacgatgcgctgatcggcgtggccggctgcgacaagacgctgcccggcatcctgatgggcatggttcgcgtcaacgtgcccggcgcgttcctgttcggcggcgcgatgctgccgggcgtggcgcccgggcagatccccggcggaggcggcacgggccagcaacgccaggcaacgatcctcacgaccatcgaagcggtgggcaccgcgcagcgcggcgacatcacccgcgcgcagctcgacgccatcgaaaagcagtgcacgccgaccgccggctcatgtcccggccagttcaccgcgaacaccatggcgatggtcgcggaagcgctgggactcgccccgctcggctcggcgatggtgccggccgtctatagcgaacgcattgcgattgcgcggcgcgctggcgaaacggtgatgcgcacgctcaaggaaggcgccccgctgccacgcgatctggttacgctgaaaagcctggagaatgcctgcgccgccgttgccgcgacgggcggctcgaccaacgccgcgctgcacattccggcgatcgcgcatgaagccggcatccgcttcacgctcgacgacgtgcagcgcgtgttcgcgcgcattccgctgatcggcgacctgcagcccggcggccgctatctcgcgcaggacctgcatcatgcgggcggcgtgccggcggtgctcaacgcgttgctggccggtggctatctgcatggcgacgccctcacgctcgacggcctcacgctggaagacgcgttgcgcggctacgccggtcccgatggcacggtggtgcgttcatgcgatgaaccgctcggcgagaacggcggcctcgtgatcctgcgcggcaatctcgcaccggacggtgcgtgcctgaaaatcgccgggctcaaagcgctgaccttctcaggtaagacgcgcatcttcgaatgcgaggaagactgcatggcggtggtcgctgcacgcgattatcgcgaaggcgacgtcctcgtgatccgcaacgaagggccgaagggcggtcccggcatgcgggagatgctcagcgtgaccgcggcgatctacggacaaggcatgggcgagaaagtcgcgctgctgaccgatggacgcttttcgggggcgacgcgcggcatgtgtatcggttatgtcggaccggaagcggcggtgggcggtccgattgcgctgctgcgcgatggtgatcgggtgcagatcgatgcgcgcgcgggaacgctgcgcgtcgagctatccgacgacgaactcgcgcgacgccgtgcggatctgccggcgaggccaaggcgccggctcgccggcgtgctggagaagtacgaggcgctggtgcggcctgcgcatctcggggcggtcacgcattcgggcaatctcgattggccctacgatgcgccgacgcatggcgacgacggagccgccgcgtga

SEQ ID NO: 114 - protein, 588 aa, Burkholderia xenovorans
MTNLHKHRSRMVTDGVTRAPHRAFLRATGLDDASMQKPFVAIVDTFGENTPCSMSLNQVSDNARLGVAAGGGIPIRGSAISVSDGTSMNHSGMRMSLVSREIVADSVELFVRAHAYDALIGVAGCDKTLPGILMGMVRVNVPGAFLFGGAMLPGVAPGQIPGGGGTGQQRQATILTTIEAVGTAQRGDITRAQLDAIEKQCTPTAGSCPGQFTANTMAMVAEALGLAPLGSAMVPAVYSERIAIARRAGETVMRTLKEGAPLPRDLVTLKSLENACAAVAATGGSTNAALHIPAIAHEAGIRFTLDDVQRVFARIPLIGDLQPGGRYLAQDLHHAGGVPAVLNALLAGGYLHGDALTLDGLTLEDALRGYAGPDGTVVRSCDEPLGENGGLVILRGNLAPDGACLKIAGLKALTFSGKTRIFECEEDCMAVVAARDYREGDVLVIRNEGPKGGPGMREMLSVTAAIYGQGMGEKVALLTDGRFSGATRGMCIGYVGPEAAVGGPIALLRDGDRVQIDARAGTLRVELSDDELARRRADLPARPRRRLAGVLEKYEALVRPAHLGAVTHSGNLDWPYDAPTHGDDGAAA

SEQ ID NO: 115 - DNA, 1767 bp, Burkholderia phytofirmans
atgaccaatctgcacaaacatcgctcgcgcagggtgaccgacggcgtcacccgcgcgccgcatcgcgcgttccttcgcgctaccggcctcgacgacgaatccatgcaaaagccgttcgtcgcgatcgtcgatacgttcggcgagaacaccccgtgttcgatgtcgctgaaccaggtctccgacaacgtgcgcctcggcattgcagcgggcggtggcgtgccgatccgcggctcggcgatctcggtgtcggacggcacgtcgatgaatcactccggcatgaggatgagcctcgtgtcgcgcgaagtggtcgcggacagcgtcgaactgttcgtgcgtgcgcataactacgacgcactgatcggcgtcgccggttgcgacaagaccttgcccggcatcctgatgggcatggtgcgcgtcaacgtgcccggtgtgttcctgttcggcggcgcaatgctgcccggcgtcgcacccggtcagttgcccggcggcgccggcaccggcctgcaacgccagtcgacgattctcacgacaatcgaagcggtcggcaccacgcagcgtggcgacatgagccgcgcgcaacttgacgccatcgaaaaacaatgcacgccgactgccggatcgtgtcccggccagttcaccgcgaataccatggcgatggtcgcggaaacgcttggcctcgcgccgctgggctccgcgatggtgcccgccgtctacagcgaacggattgcgattgcgcgccgcgccggcgagacagtcatgcgtatcctgacgcaaggcgggcccttgccgcgcgatctcgttacgatggaaagcctggagaacgcctgcgcggcagttgccgcgaccggcggttcgaccaatgccgcgctgcacattccggccatcgcgaacgaggccggcattcgcttcgcgctggacgacgtgcaacgcgtgttcgcgaaaattccgctgatcggcgatctgcaaccaggcggccgctatctcgcgcaggatctgcatcacgcgggcggcgtgccggccgtgttgaacgcgctgctggcaggcggcttcctgcatggcgatgtgcccgcgttcggcggcggcacgctcgccgaagcattgagcgcgttcagcggaccggacggcatcgtcgtgcgtccgtgcgacgagccgctcggcgaaaacggcggactcgtgatcctgcgtggcaacctcgcgccggacggcgcatgtctgaaaatcgccgggctcaaatcgctttcgttcacgggcgcggtgcgtgtattcgaatgcgaagaagactgcatggcggttgtcgcggcgcgcgactaccgcgaaggcgacgtgctcgtgatccgtaacgaagggccgaaaggcggtcccggtatgcgcgaaatgctgggtgtgacagcagcgatctacggtcagggcatgggcgagaaagtggcgttgttgaccgacggtcggttttcgggcgcgacacgtggcatgtgcatcggctatgtcggcccggaagcggcggcgggtggcccgatcggcctgttgcgcaatgacgaccgcgtgcatatcgacgcgcgcgcaggcattctgcgcgtcgacctgtccgacgacgaactcgcccgtcgccgcgccgacgcgccagcgcgcgcgtcgcgccggctcgcgggggtgctcgaaaaatacgaagcgttggtgcggcccgcgcatctcggcgcggtgacgcattcgggcaacgttgaatggccatacgacgaacccacgcccggcgacgacggagccgccgcatga

SEQ ID NO: 116 - protein, 588 aa, Burkholderia phytofirmans
MTNLHKHRSRRVTDGVTRAPHRAFLRATGLDDESMQKPFVAIVDTFGENTPCSMSLNQVSDNVRLGIAAGGGVPIRGSAISVSDGTSMNHSGMRMSLVSREVVADSVELFVRAHNYDALIGVAGCDKTLPGILMGMVRVNVPGVFLFGGAMLPGVAPGQLPGGAGTGLQRQSTILTTIEAVGTTQRGDMSRAQLDAIEKQCTPTAGSCPGQFTANTMAMVAETLGLAPLGSAMVPAVYSERIAIARRAGETVMRILTQGGPLPRDLVTMESLENACAAVAATGGSTNAALHIPAIANEAGIRFALDDVQRVFAKIPLIGDLQPGGRYLAQDLHHAGGVPAVLNALLAGGFLHGDVPAFGGGTLAEALSAFSGPDGIVVRPCDEPLGENGGLVILRGNLAPDGACLKIAGLKSLSFTGAVRVFECEEDCMAVVAARDYREGDVLVIRNEGPKGGPGMREMLGVTAAIYGQGMGEKVALLTDGRFSGATRGMCIGYVGPEAAAGGPIGLLRNDDRVHIDARAGILRVDLSDDELARRRADAPARASRRLAGVLEKYEALVRPAHLGAVTHSGNVEWPYDEPTPGDDGAAA

SEQ ID NO: 117 - DNA, 1713 bp, Bordetella petrii
atgtcactgcacaaacaccgctcgcggatggtcaccgacggcctgacccgggcgcctcaccgggcctttctgcgcgccaccgggttcgacgacgaagccctgaagaaatcaatcgttggcattgtcagtacccaaggcgaaaacacgccctgctcgatggccctggcgccccaggcggaccgcgcccgcctgggcgtggcggccgggggcggcgtgccggtcagtttttcgaccatttcggtgtcggatggcacgtccatgaaccatgccggcatgcgcatgagcctgctttcgcgcgaggcgatcgccgacagcgtggaaatggtgatgcgcggccacgcctatgacggactggtggcgttcgccggctgcgacaagacgctgcccgccatgatgatggcgatcgtgcgcctgaacgtgccggcggtgtttctctacggcggcgcgacgttgcccggccacgcgctcggcaagcaggccaccatcctggacaccatcgaggcagtgggccgcgtgcagcatggcggcatgacggccgccgagctcaagaccatggagcgtacttgcacgccatcggccggctcgtgcccgggccaattcaccgccaacaccatggccatggtcggagaagccctgggcttgtcgcccctgggcaccgccatgatgcccgcggtgtacagcgaacgcctggccatcgcccagcgggccggcgaacaagtcatgcgcgccctggcccaaggcggccccctgccgcgcgacctggtcacgcgcgccagcctggacaatgcctgcgccgcggtggctgccaccggcggctcgaccaacgcggcgctgcacattcccgccatcgctcacgaagccggcatccgctacacgctggatgacgttgccgccgtattccagcgcacgccattgatcgcggacttgcagccgggcggacgcttcctggcgcgcgacctgcacgaagcgggcggcgtgcccgccgtactgaaagccctgctggaaggcggttatatcgacggcaacgtgccgacgctcgacggccggccgctggcgcgagccctggtcgacttcgccgggccggacggcgaggtggtgcgcccctgctcgcgcgcgatccacccttcgggcggcgtcacggtgctgaaaggcaacctcagcccgcaaggcgcgctgctcaagatcgcgggcctgaaatcgctgcaattctccgggccggcgcgcgtgttcgaaaacgaagaagactgcatgcgcgcggtgtcacagcgcacctaccagcccggcgacgtgctggtcatccgcaacgaaggcccccagggcgggccgggcatgagagagatgctcagcgtgaccgccgcactgtatggacagggcatgggcgaaaaagtggccctgctgaccgacggccgcttctcgggcgcgacgcgcgggctgtgcatcggttatgtgggccccgaggccgcggcgggcggccccatcgccttcgttcgcgacggcgacatcatccatatcgacgcccaggccaataccttgcgcgtcgaactcagcgacgccgaactggccgcccgccgcgccagccatgtgccgccggcacggccgcgcctggccggcgcgctcgaaaaatacgccttgctggtgcggccggcgcacgaaggcgccgtcacgcactcggggggattggattggccctacgaaaccccggaggccgaatga

SEQ ID NO: 118 - protein, 570 aa, Bordetella petrii
MSLHKHRSRMVTDGLTRAPHRAFLRATGFDDEALKKSIVGIVSTQGENTPCSMALAPQADRARLGVAAGGGVPVSFSTISVSDGTSMNHAGMRMSLLSREAIADSVEMVMRGHAYDGLVAFAGCDKTLPAMMMAIVRLNVPAVFLYGGATLPGHALGKQATILDTIEAVGRVQHGGMTAAELKTMERTCTPSAGSCPGQFTANTMAMVGEALGLSPLGTAMMPAVYSERLAIAQRAGEQVMRALAQGGPLPRDLVTRASLDNACAAVAATGGSTNAALHIPAIAHEAGIRYTLDDVAAVFQRTPLIADLQPGGRFLARDLHEAGGVPAVLKALLEGGYIDGNVPTLDGRPLARALVDFAGPDGEVVRPCSRAIHPSGGVTVLKGNLSPQGALLKIAGLKSLQFSGPARVFENEEDCMRAVSQRTYQPGDVLVIRNEGPQGGPGMREMLSVTAALYGQGMGEKVALLTDGRFSGATRGLCIGYVGPEAAAGGPIAFVRDGDIIHIDAQANTLRVELSDAELAARRASHVPPARPRLAGALEKYALLVRPAHEGAVTHSGGLDWPYETPEAE

SEQ ID NO: 119 - DNA, 1713 bp, Bordetella bronchiseptica
atgtccctgcataagcaccgttcccgcatggttacccaaggcctgacgcgcaccccgcatcgcgccttcctgcgcgccaccggcttcgacgacgccgccctggagaaatccatggtcggcatcgtgagcacgcaaggcgagaacacgccctgctccatggcgctggggccgcaggccgaccgcgcccgcctgggcgtggccgccggcggcggcgtgccggtcagcttctcgaccatctcgatctccgacggcacctcgatgaaccatgcgggcatgcgcatgagcctgctgtcgcgcgagaccatcgccgacagcgtcgagctggtggtgcgcggccacgcctatgacgcactggtggcgttcgccggctgcgacaagacgctgccggccatgatgatggccatcgtgcggctgaacgtgccggcggtgttcctgtacggcggcgccaccctgcccggccatgcggccagcggccaggtcaccatcctcgacaccatcgaagccgtcggccgggtacagcacggcaccatgccggcggccgagctcaaggcgatggagcgcacctgtacgccctcggcgggctcgtgcccgggccagttcaccgccaacaccatggccatggtgggcgaggcgctgggcctgtcgccgctgggttcggcgatgatgcccgcggtctacagcgaacggctggccatcgcgcagcgcgccggcgagcacgtgatgcgcgccctggccgcgggcggcccgctgccgcgccagctggtgacgcgcgccagcctggagaacgcctgcgccgcggtggcggccaccggcggctcgaccaacgcggccctgcacattccggccatcgcgcacgaggccggcatcgccttcacgctggacgacgtggcccgggtgttcaagcgcacgccgctgatcgccgacctgcaacccggcggccgctatctggcgcgcgacctgcacgaggccggcggcgtgccggtggtgctcaaggcgctgctggacggcggccatatcgacggcagcgtgctgacgctcgacggccgcaccctggccgaggccctggccgacacgcccgcgcccgacggcaaggtggtgcgcgcctgcggccaggccctgcaccccaccggcggcgtcgccgtgctcaagggcaatctcagccccgatggcgcgctgctgaagatcgccggcctgaagtcgctgaaattctccgggccggcgcgcgtgttcgagaacgaggaagcctgcatgcgcgcggtgtccacgcacgcctaccagccgggcgaagtcctggtcatccgcaacgaaggcccccggggcgggccgggcatgcgcgagatgctcagcgtcacggccgccctgtatggacagggcatgggcgagaaagtggcgctgctgaccgacggccgcttctcgggcgccacgcgcggcctgtgcatcggctacgccgggccggaagcggccgccggcggccccatcgcgctgctgcgcgatggcgacatgatccacatcgacgccgaggccgatacgctggacgtggcgctgtccgacgaagagctggcgcggcgccgcgccgcctaccaggcgccgccgcaggcgcgcctggccggcgcgctggagaaatacgccgcgctggtgcgcccggcctgcctgggcgcggtcacccactccggccaggtcgattggccttacgaaacgccggaggccgaatga

SEQ ID NO: 120 - protein, 570 aa, Bordetella bronchiseptica
MSLHKHRSRMVTQGLTRTPHRAFLRATGFDDAALEKSMVGIVSTQGENTPCSMALGPQADRARLGVAAGGGVPVSFSTISISDGTSMNHAGMRMSLLSRETIADSVELVVRGHAYDALVAFAGCDKTLPAMMMAIVRLNVPAVFLYGGATLPGHAASGQVTILDTIEAVGRVQHGTMPAAELKAMERTCTPSAGSCPGQFTANTMAMVGEALGLSPLGSAMMPAVYSERLAIAQRAGEHVMRALAAGGPLPRQLVTRASLENACAAVAATGGSTNAALHIPAIAHEAGIAFTLDDVARVFKRTPLIADLQPGGRYLARDLHEAGGVPVVLKALLDGGHIDGSVLTLDGRTLAEALADTPAPDGKVVRACGQALHPTGGVAVLKGNLSPDGALLKIAGLKSLKFSGPARVFENEEACMRAVSTHAYQPGEVLVIRNEGPRGGPGMREMLSVTAALYGQGMGEKVALLTDGRFSGATRGLCIGYAGPEAAAGGPIALLRDGDMIHIDAEADTLDVALSDEELARRRAAYQAPPQARLAGALEKYAALVRPACLGAVTHSGQVDWPYETPEAE

SEQ ID NO: 121 - DNA, 1707 bp, Bradyrhizobium sp.
atgaggaagctgcgttcgcgcgtgacggtggaggggctcgaccgcgccccgcaccgcgccttcatgcgcgcgatgggcctcgatgacgccgacatcgccaagccgatgatcggaatcgtcagtcagaggggcgagcagacgccctgcaacatgacgcacgacttccaggtcgatgccgccaagaccggcatctccgagtccggcggcacgccgcgcgaattcgccaccgtctccgtctccgacggcatcagcatgaaccatgagggaatgaagttctctctgttctcccgcgagctgatcgccgattcgatcgaggccgtggtgcacggcctagcctatgacgcgctgatcggcttcggcggctgcgacaagaccttgcccggcgtgatgatgggtatggtccgctgcaacgtgccgtcgatcttcatctatggcggcagcgcgctgcccggcaagtaccagggcaagacgctcacggtgctcgactcctacgaagcggtcggcagctacatgaccggcgagatcgatgccgccacgctcgaaggcatcgagcgctcgtgcctgccgacgatcggcgcctgcgccggccagttcaccgcgaacaccatgggcatgctgtctgaggcgatgggcctgtcgatgcccaacgtctcgatgatccccggcgtctatgccgagcgcgcccatgtcgcgcgcgcagccgggcgcctgatcatgcagatgctcgccaacgatggcccgcggccgcgcgacatcgtcacccgcaaatccctggagaacggcgcggcgatcgtcgccgccaccggcggctcgaccaacgcggccctgcatctgcctgcgatcgcgaacgaggccggcatccgcttcacgctcgacgatgtcggcgaggtgttttcgcgcacgccgctgatcggcaatctcaggcccggcggcaagtatacggcgaaggacgtgtatgacatcggcggcgcggccgtcgtgatccgcgcgctgatcgacagcggccacatcgacggctcctgcatcacggtgaccggccgtacgctcgccgaggcctgcggcgcggccaatgcgccggatggcgaggtcgtgttcacgccggccaggccgatgatggccgacggcggcgtcgccgtgctcaagggcaatctcgcgccggatggtgcggtcatcaaggtcgccggtctcaagagcctggtgttcgagggccgcgcgcgcgtgtttgaagatgaagaagcctgcgtcgccgccgtccgcgcccgcaactaccaggcgggcgaggtgctgatcatccgtaacgaggggccggtcggcggccccggcatgcgcgagatgctcggcgtcaccgcgctgatctatggccagggcatgggcgagaaggtcgcgctgatcaccgacggccgcttctccggtgccacccgcggtttatgcatcggctacgtctcgccggaagccttcgtcggcggcccgctggcgctggtgcgtgatggcgatcccattcgcatcgatgcgaaagcgcgcacgctcgacgtgctgctcgacgagggcgagctcgccgcgcgtcgcagcgcgtggacgcagcggccgccgcggcatcgcgcgggagcgctggcgaaatacgcgaaactggtggggcaggcgccgctcggcgcggtcacgcatgagggaccggcggaatggccctggttcgatcaggagcaggaatga

SEQ ID NO: 122 - protein, 568 aa, Bradyrhizobium sp.
MRKLRSRVTVEGLDRAPHRAFMRAMGLDDADIAKPMIGIVSQRGEQTPCNMTHDFQVDAAKTGISESGGTPREFATVSVSDGISMNHEGMKFSLFSRELIADSIEAVVHGLAYDALIGFGGCDKTLPGVMMGMVRCNVPSIFIYGGSALPGKYQGKTLTVLDSYEAVGSYMTGEIDAATLEGIERSCLPTIGACAGQFTANTMGMLSEAMGLSMPNVSMIPGVYAERAHVARAAGRLIMQMLANDGPRPRDIVTRKSLENGAAIVAATGGSTNAALHLPAIANEAGIRFTLDDVGEVFSRTPLIGNLRPGGKYTAKDVYDIGGAAVVIRALIDSGHIDGSCITVTGRTLAEACGAANAPDGEVVFTPARPMMADGGVAVLKGNLAPDGAVIKVAGLKSLVFEGRARVFEDEEACVAAVRARNYQAGEVLIIRNEGPVGGPGMREMLGVTALIYGQGMGEKVALITDGRFSGATRGLCIGYVSPEAFVGGPLALVRDGDPIRIDAKARTLDVLLDEGELAARRSAWTQRPPRHRAGALAKYAKLVGQAPLGAVTHEGPAEWPWFDQEQE

SEQ ID NO: 123 - DNA, 1707 bp, Bradyrhizobium sp.
atgaggaagctgcgctcgcgcgtcacggtggaggggctcgatcgtgccccgcaccgcgccttcatgcgcgcgatggggctggatgatgccgacatcgccaagccgatgatcggcatcgtcagccagaagggcgagcagacgccctgcaacatgacgcacgacttccaggtcgacgccgccaagacgggcgtctccgaagccggtgggacgccgcgcgaattcgccaccatctcggtgtcggacggcatcagcatgaaccatgagggaatgaagttctctctgttctcgcgcgaactgatcgcggattcgatcgaggccgtggtccatggtctcgcttatgacgcgctgatcggctttggcggctgcgataagaccctgccgggcgtcatgatgggcatggttcgttgcaacgtgccgtcgatcttcatttatggcggcagcgctctgcctggcaagttccagggcaagacgctcacggtgctcgattcgtatgaagcggtcggcagctacatgaccggcgagatcgatgtcgcgacgctcgagggcatcgagcggtcgtgcctgcccaccatcggcgcctgcgccgggcagttcaccgccaacaccatgggcatgctgtccgaggcgatgggcctgtcgatgcccaacgtctcgatgatccccggcgtctatgccgagcgcgcccatgtcgcgcggcaggccggccggctgatcatgcagatgctggctcgtggtgggccgctgccacgcgatatcgtgacccgcaaggccctggagaacggtgcggcgatcgtcgccgccaccggcggctcgaccaatgccgcgctgcatctgccggcgatcgccaacgaagccggcatccgtttcacgctcgacgatgtcggcgaggtcttcgcccgcacgccgctgatcggcaatctccggccgggcgggaagtacaccgccaaggacgtctatgacatcggcggcgcggccgttgtgatccgcgcgctgatcgagagcggccatatcgacggctcctgcatgacggtgaccggccgcacgcttgccgaggactatggggccgccaatgcgcccgatggcgagatcgtgtttcatccggccagcccgatcatggcggagggcggcgtcgccgtgctcaagggcaatctggcgcctgacggcgcggtcatcaaggtggccggcctgaagaacctcgtattcgaggggcgggcccgcgtattcgaggatgaggaagcctgcgtcgccgccgtccgcgcgcgcaactatcaggcgggcgaggtactgatcatccgcaacgaggggccggtcggcggtcccggcatgcgcgaaatgctcggtgtgaccgcactgatctacggtcagggcatgggcgagaaggtggcgctgatcaccgacggccgcttctccggagcgacgcgcggcatgtgcattggctatgtctcgccggaagccttcgtcggcggtccgttggcgctgctgcgcgacggcgatccgattcgcatcgatgcaaaagcgcgcacgctcgacgtcctgctcgacgacgccgagctcgcggcccgtcgcgccgcgtggtcgcagcggccgccacggcatcgcgccggcgcgctggcgaaatatgccaagctcgtcggccaggcaccgctcggcgccgtgacgcatgaaggacccgcggactggccgtggttcgatcaggagcagaaatga

SEQ ID NO: 124 - protein, 568 aa, Bradyrhizobium sp.
MRKLRSRVTVEGLDRAPHRAFMRAMGLDDADIAKPMIGIVSQKGEQTPCNMTHDFQVDAAKTGVSEAGGTPREFATISVSDGISMNHEGMKFSLFSRELIADSIEAVVHGLAYDALIGFGGCDKTLPGVMMGMVRCNVPSIFIYGGSALPGKFQGKTLTVLDSYEAVGSYMTGEIDVATLEGIERSCLPTIGACAGQFTANTMGMLSEAMGLSMPNVSMIPGVYAERAHVARQAGRLIMQMLARGGPLPRDIVTRKALENGAAIVAATGGSTNAALHLPAIANEAGIRFTLDDVGEVFARTPLIGNLRPGGKYTAKDVYDIGGAAVVIRALIESGHIDGSCMTVTGRTLAEDYGAANAPDGEIVFHPASPIMAEGGVAVLKGNLAPDGAVIKVAGLKNLVFEGRARVFEDEEACVAAVRARNYQAGEVLIIRNEGPVGGPGMREMLGVTALIYGQGMGEKVALITDGRFSGATRGMCIGYVSPEAFVGGPLALLRDGDPIRIDAKARTLDVLLDDAELAARRAAWSQRPPRHRAGALAKYAKLVGQAPLGAVTHEGPADWPWFDQEQK

SEQ ID NO: 125 - DNA, 1749 bp, Bradyrhizobium japonicum
atgaagttgcgatgtcccgccgcgtacgggacatcgcacgtagatgatgcaaatatgaagaagttgcgatcacggataacgacagacggcctcgaccgggccccgcaccgcgcattcatgcgcgcaatggggctggacgatgcggcaatcgccaagcccatggtaggcattgtcagcatgaagggcgagcagacgccctgcaacatgacccacgacttccaggtggccgcggccaagacaggtattgaggaggccggcggcacgccgcgcgaattctcgaccgtgtcggtctctgacgggatcagcatgaatcacgagggaatgaagttctccctcttttcgcgcgagctgatcgccgactcgatcgaggctgtcgttcatggtctcgcctatgacgcgttgatcggatacggcggatgcgacaagacgcttcccggcgtgatgatgggcatggttcgttgcaacgtgccgtcgattttcatctacggcggcagttcgctgccggggcgcgtggacggacgaacgctgacagtgctcgactcctacgaggctgtcggcagcttcatgaccggagagatcgatagcgccacactggagcggatcgagcgcgcctgcctgccgaccatcggtgcgtgcgcgggccagtttactgcgaacaccatgggaatggtgtcggaggcgatggggctcaccattcccaacgtctcgatggtgcccggtgtctacgccgagcgcgcgcagatctcgcgacgcgccgggcggctgatcatggaaatgctggaacgcggtgggccgctgccacgggacatcgtgacgcggaaatccctcgagaacggggcggcgatcgtcgccgctacgggcggctcgaccaacgccgcgctgcatctgcccgccatcgcgaacgaggccggcatcgcattcacgatcgacgatgtcggcgaggtctttgccaggacgccgctgatcggaaatctgcggcccggaggcaaatacacggcgaaggatgtccacgacataggtggcgccgccgtggtgatccaggagttgatcagaaccggtcatatcgacggtaactgcatcaccatcaccggccggacgcttgccgaagaatatggcgcggccaacgcgccggacggtgaggtcgtttacgcggcaagtgcgccgatcatgccggatggcggtgtcgcggtgctgaagggcaacctctgtccggacggtgcggtcatcaaggtcgcaggtttgaagagccagttcttcgagggtgtcgcgcgcgttttcgaagacgaggaggcttgcgtcgcagcggttcgcgaccgcagctacaaggcaggtgaggtcctggtgatccgcaacgaagggccggtcggcggccccggtatgcgcgagatgctcggcgtcaccgcgctgatctacgggcagggcatgggcgaaaaggtggccctgatcaccgacgggcggttctccggcgcgacccgcggcatgtgtatcggctacgtgtcccccgaagcattcgttggcggtccgttggccctcgttcgcgacggcgacaagatccggattgatgctacaaaccggcgtatggatatgctggtcgacgagccggagctcgcggcgcgccgacgtgattggaaaccacgcccgccgcgtcaccgcgcaggcgcgctcgcaaaatatgcgcgactggtcggccaggcgccgggcggagcggttacccatgaggggcccgcagaatggccctggttcgaatga

SEQ ID NO: 126 - protein, 582 aa, Bradyrhizobium japonicum
MKLRCPAAYGTSHVDDANMKKLRSRITTDGLDRAPHRAFMRAMGLDDAAIAKPMVGIVSMKGEQTPCNMTHDFQVAAAKTGIEEAGGTPREFSTVSVSDGISMNHEGMKFSLFSRELIADSIEAVVHGLAYDALIGYGGCDKTLPGVMMGMVRCNVPSIFIYGGSSLPGRVDGRTLTVLDSYEAVGSFMTGEIDSATLERIERACLPTIGACAGQFTANTMGMVSEAMGLTIPNVSMVPGVYAERAQISRRAGRLIMEMLERGGPLPRDIVTRKSLENGAAIVAATGGSTNAALHLPAIANEAGIAFTIDDVGEVFARTPLIGNLRPGGKYTAKDVHDIGGAAVVIQELIRTGHIDGNCITITGRTLAEEYGAANAPDGEVVYAASAPIMPDGGVAVLKGNLCPDGAVIKVAGLKSQFFEGVARVFEDEEACVAAVRDRSYKAGEVLVIRNEGPVGGPGMREMLGVTALIYGQGMGEKVALITDGRFSGATRGMCIGYVSPEAFVGGPLALVRDGDKIRIDATNRRMDMLVDEPELAARRRDWKPRPPRHRAGALAKYARLVGQAPGGAVTHEGPAEWPWFE

SEQ ID NO: 127 - DNA, 1686 bp, Sphingomonas wittichii
atggcgttgaaggacgggaagggcgagacgcttccctcgcggacgatcaccgacgggctcgaccgcgccccgcaccgcgccttcctgcgggcgatggggcatgacgacgtggcgatcggccagcccttcgcgggcatcgtctcgaccggggcgtcggtgacgccctgctcgatgtcgctggcgcctcaggccgaggcggcgaaggccgggctccaggcggcgggggtgacgccgttcgaattctcgacgatcaccgtcgccgacagcatgtcgatgaaccatgccgggatgcgtttcagcctggtctcgcgggagatcatcgccgattcgatcgaggcggtgacgcgggcgcatggctatgacgggctgatcggcttcgcggcctgcgacaagacgttgccgggcacgatgatggggatgatccgggtcaaccgcccgtcggtgttcgtctatggcggcgcggcgctgcccggccgctggcaggggcgcgacatcggcatcgtcgacgtctatgagggcgtcggccgggtctatgccggcgagatggacgaggccgagctgacgcgcctcgaaaaggcgggggtgccgaccgtcggctcctgcgccgggcagttcaccgccaacaccatggcgatggtcgccgagacgctgggcctggcgctgccgcgcagcgcgatgatgccggcggtggcgagcgagcgccgcgcgctggccgaggaatcgggccgcgtgctcggccggctgatccgcgagggcggcccgcgcccgcgcgacctcgtcacccgtcgcagcctcgaaaacgccgccgccaccgttgccgccaccggcggctcgaccaacgccgcgctgcacctgccggcgatcgcacatgaggcaggcatatccttcaccatggaggacatcgccgcgatcttcgaccgcaccccgctgctcgccgacctcaagcccggcggccgcttctgggcgcgcgacctgcacgaggtcggcggcgtgccgaccgtgctgcgggcgatgctggaggcgggcgtgctgcacggcgactgcccgaccatcaccggccggacgatcggcgagatcgccgccgccgcgcccgcgccggacggggaggtggtgcgccccgccgaccggccgatcgcgccgaccggcggggtgatcgtgctgcgcggcagcctcgcccccgacggcgcgatgctcaaggtcgccgggctcaagcgcctgtcgcacgaagggccggcgcgggtgttcgacggcgaggaggcggcggtcgacgcggtccgccggcaggattaccagccgggcgacgtcatcgtcatccgtggcgaggggccgaagggcggccccggcatgcgtgagatgctgggcgtcaccgcgctgatctacggccagggcatgggcgaacaggtcgcgctgctcaccgacggccgcttctcgggcgcgacgcgcggcatgtgcatcggccatgtcggcccggaggcctcggccggcggcccgctcgcgctggtccgggacggcgatcgcatccgcatcgacgcgggccagcgcacgctcgacctgctcgtcgatgccgccgagctggagcgccgccgcgcggcctggaccgcgccggaggctaccgtcacctcgccgaccttgcgcaaatatgcgcggctcgtcgggccggcgcatctcggcgccgtcacccactga

SEQ ID NO: 128 - protein, 561 aa, Sphingomonas wittichii
MALKDGKGETLPSRTITDGLDRAPHRAFLRAMGHDDVAIGQPFAGIVSTGASVTPCSMSLAPQAEAAKAGLQAAGVTPFEFSTITVADSMSMNHAGMRFSLVSREIIADSIEAVTRAHGYDGLIGFAACDKTLPGTMMGMIRVNRPSVFVYGGAALPGRWQGRDIGIVDVYEGVGRVYAGEMDEAELTRLEKAGVPTVGSCAGQFTANTMAMVAETLGLALPRSAMMPAVASERRALAEESGRVLGRLIREGGPRPRDLVTRRSLENAAATVAATGGSTNAALHLPAIAHEAGISFTMEDIAAIFDRTPLLADLKPGGRFWARDLHEVGGVPTVLRAMLEAGVLHGDCPTITGRTIGEIAAAAPAPDGEVVRPADRPIAPTGGVIVLRGSLAPDGAMLKVAGLKRLSHEGPARVFDGEEAAVDAVRRQDYQPGDVIVIRGEGPKGGPGMREMLGVTALIYGQGMGEQVALLTDGRFSGATRGMCIGHVGPEASAGGPLALVRDGDRIRIDAGQRTLDLLVDAAELERRRAAWTAPEATVTSPTLRKYARLVGPAHLGAVTH

SEQ ID NO: 129 - DNA, 1683 bp, Rhodobacterales bacterium
atgaccaaacgcgacacgctcatctcacgcaccatcgtggaggggctcgaccgtgcgccccaccgcgccttcctgcgcgcgatggggcacgacgacacggcactggccagcccgttcgtcggcatcgcacataccgcgagcgaggtgacgccctgcaccatgtcgctcccgccgcagatccagtcggccaagttaggcatcacccgcgaaggaatgaccccgttcgaattcggcacgatcaccgtggccgacagcatgtcgatgaaccatcgcgggatgcgcttttcgctcgtctcgcgtgagatcatcgcggacagcatcgacgcagtggtgcgcggccatgcctatgacgggctgatgaccttcgcctcctgcgacaagacgctgccgggcatgttgatggccatcgcgcgcatcaaccgcccttcggtctttctgtatggcggggccgcgctgccgacgccgtggaacgggcaggacatcggggtggtcgacgtctacgaaggcgtggggcgcgtctatgaggggacatcgagcgaggaagagctcgacgcgatggaacgggtgggcgtgcccactgtcggctcctgcgccgggcagttcacggccaacaccatggcgctcgtggccgaggttctgggcttggcccccctcggtgtcgcctaccttcccgccgtctattccgaacggcaggcactggtgaaacgcgcggcgggtctgttgcgccgcgcggtggacgagaacggcccgctgccctcggacctcatcacgcgcgagtcgctggaaaacgccgtggtcgctgtgggcgcgacgggcgggtcgaccaatgccctcctgcacctgcccgcaatcgcgaacgaggtcgggatcagcttcacgctggacgacatcgcgaaggtgcttgaggacgtgccgctggtcgccgacctgaaacccggcggcgcctactgggcgcgcgacatgcaccacgtgggcagcaccccggcgctcctgcgcgtgttgaagggggcgggcgtgctgcacacggacacgccgagtgtcgagggccggacgctgggtgaactggccgacaccggacctgaagcggacggcaaggtgatccgagccgtgggcaatccggtcacgccgacctcaggcgtggtggtgctcaaggggtcgctcgcccccgaaggggcggtgctcaaggtcgcgggtctcaagcacacagttcacgaaggccccgcgcgggtgttcgagtgcgaggaggatgccgtggccgccgtgcgcaagcgcgaatacgaggcgggcgacgtgattgtgatccgcaacgaaggccccaagggcgggccggggatgcgcgagatgctgggcgtcaccgcgctcctctacggtcagggcatgggcgagaaggtcgcgctcatcaccgacggccgcttctcaggcgcgacgcggggtctgtgcatcggtcacgtcgggcccgaggcggcggcgggtggtcccatcggcctgatccgcaccggcgacatcatccagatcgacgcgggcaaacgggagttgaacgtcaaactatcgacagacgagcttgcccggcgcacccgccccccggtgcccgaggggctggaacccgaaacggcgaccctgcgcaaatacgcggctctcgtcggccccgcgcatctgggcgcgaccacgcaccggaacacctag

SEQ ID NO: 130 - protein, 560 aa, Rhodobacterales bacterium
MTKRDTLISRTIVEGLDRAPHRAFLRAMGHDDTALASPFVGIAHTASEVTPCTMSLPPQIQSAKLGITREGMTPFEFGTITVADSMSMNHRGMRFSLVSREIIADSIDAVVRGHAYDGLMTFASCDKTLPGMLMAIARINRPSVFLYGGAALPTPWNGQDIGVVDVYEGVGRVYEGTSSEEELDAMERVGVPTVGSCAGQFTANTMALVAEVLGLAPLGVAYLPAVYSERQALVKRAAGLLRRAVDENGPLPSDLITRESLENAVVAVGATGGSTNALLHLPAIANEVGISFTLDDIAKVLEDVPLVADLKPGGAYWARDMHHVGSTPALLRVLKGAGVLHTDTPSVEGRTLGELADTGPEADGKVIRAVGNPVTPTSGVVVLKGSLAPEGAVLKVAGLKHTVHEGPARVFECEEDAVAAVRKREYEAGDVIVIRNEGPKGGPGMREMLGVTALLYGQGMGEKVALITDGRFSGATRGLCIGHVGPEAAAGGPIGLIRTGDIIQIDAGKRELNVKLSTDELARRTRPPVPEGLEPETATLRKYAALVGPAHLGATTHRNT

SEQ ID NO: 131 - DNA, 1665 bp, Solibacter usitatus
atgaaactgcagagccataccatcactcagggacgagatcgcgccccggcgcgcgccatgttgaaagcgatcgggtttaccgatgaagatctggccaagccgatcatcgggatcgccaacacctggatcgagaccatgccgtgcaattacaacctgcgtgagctggccggcaaagtgaaggagggcatccgcgccgccggcgggacgccgatggagttcaacaccatcgcgatcagcgacggcgtcaccatgggcacggaaggcatgaaggcctcgctgatcagccgtgaagtaatcgcggattccatcgagctgatggtgcgcggccacatgttcgatggcatcgtcgccatggtggcctgtgacaagaccattcccggcgccgcgatggcgctgctccgcctcaacgtcccgggcgtggtgctttatggcggcaccatcatgccgggccgcttcgagggtcacgacatcacgattcaggacgtgtttgaagccgtcggcgcgcacgcgcgcggcaagatcaccgacgcgcaattgctcgacatcgaagaccacgcctgccccggcgccggagcctgcggcggacagttcacggccaacaccatggccaccgtgatggagctgatcggactctccccgatgggcacggctgccgttccccaggtggacaagcgcaaagacgcagtggcgtaccgctgcggcgaggttattctgaacgccgtgcgcaagaacattctgccgcgcgatatttgcacccgcaaagccttcgagaatgcgattgcaggcgtcgccggaacggccgggtccaccaacgccgtgctgcacctgctggccatggcgcgcgaagccgaagtgccgctgaccatcgatgagtttgaaccggtgctggcgcggacgccggtcttcgtcgatatcaaacccggcggaaagtacatggccgcggacgtggataaggccggcggcattccggtgatcgccaaccgcctgctcgagggcggctacgtggatggctcggcgatcacgatcaccggacgcaccttcgccgaagaagcgaacgaggccaaggaagtcgccgggcagccggtgattcttccgctcgccaaagcgctcaagccgcgcggcggtatcgcgattcttcgcggctctctggcgcccgaaggctgcgtgatcaagctggcaggccacgagaagaaatcgcaccacggtccggcgcgcgtgttcgagcgtgaggaagaggccatggcggccgtgcaggaaggcaagattcgcgagaacgacgtggtagtgatccgctacgaaggtccgcgcggcggccccggcatgcgcgagatgctgggcgtcaccggagccattgtcggcgccggtctgagcgatagcgtagcgctcttgaccgatggccgcttcagcggcgccacgcacggtttcatgatcgcgcacgtggcacccgaggcctttaacggcggcccgatcgcggtcgttcaggaaggcgacatgatcacggtggacgcaacccgcggcgtgcttgaattggatattcccgccggggaactgaagagccggctggccgcatggaagccccgcgaaccccgttacaagaaaggcgtgatcgcgaagtactgcaagctggtttcaagcgcgagcgaaggcgcgatcactcaagcatga

SEQ ID NO: 132 - protein, 554 aa, Solibacter usitatus
MKLQSHTITQGRDRAPARAMLKAIGFTDEDLAKPIIGIANTWIETMPCNYNLRELAGKVKEGIRAAGGTPMEFNTIAISDGVTMGTEGMKASLISREVIADSIELMVRGHMFDGIVAMVACDKTIPGAAMALLRLNVPGVVLYGGTIMPGRFEGHDITIQDVFEAVGAHARGKITDAQLLDIEDHACPGAGACGGQFTANTMATVMELIGLSPMGTAAVPQVDKRKDAVAYRCGEVILNAVRKNILPRDICTRKAFENAIAGVAGTAGSTNAVLHLLAMAREAEVPLTIDEFEPVLARTPVFVDIKPGGKYMAADVDKAGGIPVIANRLLEGGYVDGSAITITGRTFAEEANEAKEVAGQPVILPLAKALKPRGGIAILRGSLAPEGCVIKLAGHEKKSHHGPARVFEREEEAMAAVQEGKIRENDVVVIRYEGPRGGPGMREMLGVTGAIVGAGLSDSVALLTDGRFSGATHGFMIAHVAPEAFNGGPIAVVQEGDMITVDATRGVLELDIPAGELKSRLAAWKPREPRYKKGVIAKYCKLVSSASEGAITQA

SEQ ID NO: 133 - DNA, 1680 bp, Roseiflexus sp.
atgtctagcgacctcaaacgccgcagtcgcaccattaccgatgggcgcacccgcgccggggcgcgcgccatgctcaaggcaatcggcttcaccgacgaagacctggcaaaaccgatcatcggcatcgccaatacctggatcgagacgatgccatgcaacatcaacctgcgcgcgctggcggcgcgggtcaaggaaggcgtgcgcgccgccggcggcacgccgatggagttcaacaccgtcgctatcgccgatggcgtcaccatgggtacggaagggatgaaggcgtcgctgatcagccgcgacctgattgccgactcgatcgaactgatggggcgcgggtatatgttcgacgcgatcatcgcgctggtggcatgcgacaaaacgatccccggagcagcgatgggattgacgcgcctgaacatccccggcttcctgctctacggcggatcgattgctcccggtcactggcgcggcaaagagatcaccatccagcatgtgtacgaagcgatcggtgcagttgccgccggtaagatgaccgacgaagaactgaaagagatcgaagatgccgcgtgccccggtccgggagcatgcggaggtcagtacactgccaacacgatggcaaccgtgatggaaattatcggtctctcgccgatggggacggctgcggtgccggctgccgacccgcgcaaagattcggttggataccgcgccgggcagttgattatggatgtgctgcgacgcgatctgaagccgcgcgatattctgacacgggcggcattcgagaatgcgatcgccagcgtggcgttgaccggcggctcgaccaacgcggtactccatctgctggcgctggcgcgtgaggcgggcgtgccgctaacgctcgacgatttcgacgcgatcagtcgtcgtacaccgctctgctgcgacctgatgccgagcgggaagtactctgccattcacgtcgatcaggcgggcggcattcaggtgattgcgagacgcctggtcgacggcggtttcgcgcacggcgatgcgatcaccgtcactggtcgcaccctggcggaagaggcggcggatgctgtcgaaacgccaggtcaggatgtgatccgtcccctcgataatccgatcaagccgacaggcgggttgctggtgctgcgcggcaatctggcgcccgaaggatcggtggtcaaactgttcggttatgagcgcacctaccaccgcggtccggcgcgcgtcttcgatggcgaagaggcggcaatggccgctatcgtcggcggtgaaattcgaccggacgatattgtgattattcgctatgaaggtccgcgcggcggtcctggcatgcgcgagatgctcggcgttacttccgcgattgtcggcgccggacttgggcagtcggtctcgctcattactgatggacgcttcagcggcgcgacgcgcggtgtgatgatcggacacgtggcgccggaggcggcgcgaggcggaccgcttgcgattgtgcaggagggggatgagatcgagatcaatctcgacgagcgccgtgttgatctgctgctgtcagaagaagagattgccgaccggttgctcgcctggcagccgccagcgccgcgttatgagtggggcgtgatggcgcgctacggtgcgctggtgtcgtcagcgtccgaaggcgccgtgctggtgacaccatga

SEQ ID NO: 134 - protein, 559 aa, Roseiflexus sp.
MSSDLKRRSRTITDGRTRAGARAMLKAIGFTDEDLAKPIIGIANTWIETMPCNINLRALAARVKEGVRAAGGTPMEFNTVAIADGVTMGTEGMKASLISRDLIADSIELMGRGYMFDAIIALVACDKTIPGAAMGLTRLNIPGFLLYGGSIAPGHWRGKEITIQHVYEAIGAVAAGKMTDEELKEIEDAACPGPGACGGQYTANTMATVMEIIGLSPMGTAAVPAADPRKDSVGYRAGQLIMDVLRRDLKPRDILTRAAFENAIASVALTGGSTNAVLHLLALAREAGVPLTLDDFDAISRRTPLCCDLMPSGKYSAIHVDQAGGIQVIARRLVDGGFAHGDAITVTGRTLAEEAADAVETPGQDVIRPLDNPIKPTGGLLVLRGNLAPEGSVVKLFGYERTYHRGPARVFDGEEAAMAAIVGGEIRPDDIVIIRYEGPRGGPGMREMLGVTSAIVGAGLGQSVSLITDGRFSGATRGVMIGHVAPEAARGGPLAIVQEGDEIEINLDERRVDLLLSEEEIADRLLAWQPPAPRYEWGVMARYGALVSSASEGAVLVTP

SEQ ID NO: 135 - DNA, 1701 bp, Rubrobacter xylanophilus
atgcagaccacggacctcaggcgcaagagccgcatcatgttcgaggggcgggaccgggcccccgcccgctcctaccttctgggcatgggctacactcgggaggacctcgagaagcccatcgtgggggtggcccactcctggatcgagaccatgccctgcaactacaaccaccgccggctggccgagaaggtcaaggagggcatccgggcggccgggggcacccccatggagctgaacaccatcgcgatctccgacgggatcacgatgggcacccaggggatgaagacctccctggtctcgcgcgaggtgatcgccgactccatcgagctggtggggcgcggccacatgttcgacgccatggtgatcctggtcggctgcgacaagaccatccccgccggggcgatggcgctggcccggctggacgtccccggcatggtcatctactccggctccatagccccggggcgcttcaggggccgcgacgtgaccatccaggacgtcttcgagggggtgggcgcccacgccgcgggcaagatgagcgacgaggagctgcgggagctggaggagggggcctgcccgggcgcgggggcctgcggcggccagtacaccgccaacaccatggccatagcgctgcagtttttgggcctctcgccggtgggctccgccgacccgcccgccctggacggccgcaaggaggcggtctgcgaggaggcgggccggctggtgatgcgcctgctggagcgggacctcaagccctcggacatcctgagccgcgcggccttcgagaacgccatcgcctccgtggccgctaccgggggctccaccaacgcggtgctccacttcctcgccctcgcccaggaggcgggcatcccgctggacatagaggacttcgaccgggtcagctcccgcacccccatcatcgcggacctgaagcccggcggccgctttacggccgtggacatggaccgcgcagggggctcccggctgctgggcgcgcggatgctggaggcgaacctcgtggacggctcccagcccaccgtcaccgggcgcaccctggccgaggagttcgagggcgcgcgggagcgcccggggcaggaggtgatcctctccgccgagaggtccctcagcgagagcggcggcctggtgatcctcaagggcaacctggcccccgagggctgcgtggtgaaggtcgcgggctacacccgccgccgccacgagggtccggcgcgcgtcttcgactccgaggagcaggcgatggaggcggtccaggccggccggatctcggcgggcgacgtggtggtgatccgctacgaggggccgcgcggcggccccgggatgcgcgagatgctgggggtgaccgccgcgctggtgggccaggggctcggcgagagcgtggcgctgctaaccgacgggcgcttctcaggggccacccgcgggctcatggtgggccacgtcgccccggaggcggcccgcggcggccccatagccgccctgcgcgacggggaccgcatcacgatcgacgtcaccggcaggacgctgagcgtggcgctcaccggcgaggagctgcggaggcgcctggagaactggcgggagcccgagccgcgcttcaggctcggggtgatggccaagtacgccgccctcgtctcctcggcctccgagggggcggtgaccgtcccggactggcagcgccgcgccacctga

SEQ ID NO: 136 - protein, 566 aa, Rubrobacter xylanophilus
MQTTDLRRKSRIMFEGRDRAPARSYLLGMGYTREDLEKPIVGVAHSWIETMPCNYNHRRLAEKVKEGIRAAGGTPMELNTIAISDGITMGTQGMKTSLVSREVIADSIELVGRGHMFDAMVILVGCDKTIPAGAMALARLDVPGMVIYSGSIAPGRFRGRDVTIQDVFEGVGAHAAGKMSDEELRELEEGACPGAGACGGQYTANTMAIALQFLGLSPVGSADPPALDGRKEAVCEEAGRLVMRLLERDLKPSDILSRAAFENAIASVAATGGSTNAVLHFLALAQEAGIPLDIEDFDRVSSRTPIIADLKPGGRFTAVDMDRAGGSRLLGARMLEANLVDGSQPTVTGRTLAEEFEGARERPGQEVILSAERSLSESGGLVILKGNLAPEGCVVKVAGYTRRRHEGPARVFDSEEQAMEAVQAGRISAGDVVVIRYEGPRGGPGMREMLGVTAALVGQGLGESVALLTDGRFSGATRGLMVGHVAPEAARGGPIAALRDGDRITIDVTGRTLSVALTGEELRRRLENWREPEPRFRLGVMAKYAALVSSASEGAVTVPDWQRRAT

SEQ ID NO: 137 - DNA, 1779 bp, Salinispora tropica
gtgacgacccggcctaacccactcttcgtcggcatcgagcgcgccccagcgcgcgcctccatgcgcgccacaggtctgtcgaccgaggacctgaagaagccgatgatcggggtagcgcacagttggatcggcacgatgccgtgcaacctcaaccaccggcggctcgcccaggaggtgatggccggcgtgcgcgccgcaggtggcaccccgatcgagatcaacaccatcgcgatctcggacgtgatcaccatgggcacggagggaatgcggacctcactggtgagccgcgaggtgatcgccgactccatcgagttggtatgccgcggccacggtctcgacggcctggtgaccctggccggctgtgacaagaccatacccggtgcggcgctggcccacgtgcgactcgacatccccggagccgtcatctattccggcacgatgatgccgggcgagcacctcgggcgcgacatcaccctgcaggatgtgtttgaggccgtcggcagcgccaccgccaccggctgcaccgacgagctcgacaagctcgagcgcgcggcctgtcccggtatcggggcctgcgcgggccactacacggccaatacgatggccgtggtgctggagttcctcgggctttccccgttcggctcgatggatccgccggcagtcgacgcccgcaaggacacggtctgccgccaggccggcgagctggtcatgcgggcggtggcagaagggctgcggcccagccggttcctgacgccctcctcgttgcgcaacgccatcgccgccggggtcgccaccggcggctcgacgaacatggtgctccacctgttggcgatcgctcgggaggcgggcatcccgctggacattgacgagttcgaccggatcagctcggtgaccccgatcatcgctgacctgcgtccaaacgggacgtacaccgcggtggacctcgaccgggcgggcggcacccgggtgatcgcccgccacatggtcgacgcgggcctgattgctggcgacgaaagcaccgtcaccggccgcaccgtcgcacacgaggccgcggacgcggccgagacacccggccaacgggtcgtcaccacggtggaggcacccctatcgccttccggtgctctcctgatcttgcggggtaacctagcgcccgatggcagtgtggtgaaggcacccggcgcggtgaccctgcggatgaccggcaccgcattggtgttcaactgcgaggaggaagcgatggccgcggtccagactggccgcgtccggccaggccacgtcgtcgtcatccgctacgagggtccgcgcgggggtccagggatgagggaaatgctcggagtgacctcggcgctcatcggccgcggcctgggcacgtcggtcggtctggtgaccgacggccgtttctcgggcgcgaccaggggactgatggtggggcacgtcgctccggaggcggcggagggcggaccgatcgcggcggtgtgcgacggtgaccggatcaccatcgacctgcagcggcgcgaatgctctgtcgacctggatccgggcgaactggccgcgcggatgcgagactggtcggctccgccaccgcgctacacgatcggcgtcatggccaaatactggtcgacggtctcgtcggcggccgtgggcgccgtgacgaccccgcaccccacccagggcccggcgacagcgtcaggtaaggccgaggagtgccagcaggcgagtgcggtcgagggcgtgatggcggttggcggcggcgatgtcggtgctgccggcggttcgtag

SEQ ID NO: 138 - protein, 592 aa, Salinispora tropica
MTTRPNPLFVGIERAPARASMRATGLSTEDLKKPMIGVAHSWIGTMPCNLNHRRLAQEVMAGVRAAGGTPIEINTIAISDVITMGTEGMRTSLVSREVIADSIELVCRGHGLDGLVTLAGCDKTIPGAALAHVRLDIPGAVIYSGTMMPGEHLGRDITLQDVFEAVGSATATGCTDELDKLERAACPGIGACAGHYTANTMAVVLEFLGLSPFGSMDPPAVDARKDTVCRQAGELVMRAVAEGLRPSRFLTPSSLRNAIAAGVATGGSTNMVLHLLAIAREAGIPLDIDEFDRISSVTPIIADLRPNGTYTAVDLDRAGGTRVIARHMVDAGLIAGDESTVTGRTVAHEAADAAETPGQRVVTTVEAPLSPSGALLILRGNLAPDGSVVKAPGAVTLRMTGTALVFNCEEEAMAAVQTGRVRPGHVVVIRYEGPRGGPGMREMLGVTSALIGRGLGTSVGLVTDGRFSGATRGLMVGHVAPEAAEGGPIAAVCDGDRITIDLQRRECSVDLDPGELAARMRDWSAPPPRYTIGVMAKYWSTVSSAAVGAVTTPHPTQGPATASGKAEECQQASAVEGVMAVGGGDVGAAGGS

SEQ ID NO: 139 - DNA, 1722 bp, Acidobacteria bacterium
atgaccgaaaaatccccaaagccacacaagcgtagcgacgccattaccgaaggtcccaaccgcgccccagcccgcgccatgctgcgcgccgccgggttcaccccggaagaccttcgtaagcccatcatcggcatcgccaacacctggatcgaaatcggtccctgcaacctgcaccttcgtgagctcgccgagcacatcaagcagggcgttcgcgaagccggcggtacgccaatggagttcaacaccgtctccatttctgacggcatcaccatgggctcggaaggcatgaaggcgtcgctggtcagccgcgaggtcatcgccgactccatcgaactcgtcgcgcgcggcaatcttttcgacggcctgatcgccctatcgggatgcgataaaaccatccccgggaccatcatggcgctcgagcgcctcgacatcccgggtctcatgctctatggcggctccatcgcgcccggcaaattccatgctcagaaggtcacgattcaagacgtcttcgaggcagtcggtacgcatgcgcgcggcaaaatgagcgacgctgatctcgaagaactcgaacacaacgcctgtcccggcgccggcgcctgcggtggacaattcaccgctaacaccatgtccatgtgcggcgaattcctcggcatctcgccgatgggcgctaacagcgtcccggcgatgaccgtagagaagcagcaggtcgcacgacgctgcggacacctcgtcatggaactggtccgccgcgacatccgccccagccaaatcatcacgcgcaaggcgatcgaaaacgcaatcgccagcgtcgccgcctccggcgggtcgaccaacgccgttcttcacttgctcgccatcgcgcacgaaatggacgtcgaactgaacatcgaagacttcgacaagatcagttcgcgcacgccactgctctgcgaactcaagcccgctggccgcttcaccgccaccgatcttcatgatgccggcggtattccgctcgtcgcgcaacgcctgctcgaagcgaacctgctgcacgccgacgcactgactgtcaccggtaagaccatcgccgaagaagcgaagcaggcgaaagaaacgccgggccaggaagtggttcgtccgcttaccgatcccatcaaagctaccggcggcctcatgatcctgaaaggcaacctcgcatccgaaggctgcgtggtcaaactcgtcggacacaagaagctcttctttgaaggccccgctcgcgtcttcgagtcggaagaagaagcctttgcgggcgtggaagaccgcaccatccaggcgggcgaagtggtcgtggtccgatatgaaggcccgaagggcggccctggcatgcgcgaaatgcttggcgtgacggcggccatcgccggcaccgaactcgccgagaccgtcgcgctcatcaccgacggacgtttctccggcgctacccgcggcttgagcgtgggccacgttgcgcccgaagccgcgaatggcggcgcgatcgctgtggtacgcaatggcgacatcatcactctcgacgtggaacgccgcgaactgcgcgtccacctcaccgacgcagaactcgaagcgcgcctccgcaactggcgcgcgccggagccacgatacaagcgcggcgtcttcgccaagtatgcgagcaccgtttcgtcggcgtcgttcggggccgttaccggctccaccatcgaaaacaagaccttagccgggagtacgaagtag

SEQ ID NO: 140 - protein, 573 aa, Acidobacteria bacterium
MTEKSPKPHKRSDAITEGPNRAPARAMLRAAGFTPEDLRKPIIGIANTWIEIGPCNLHLRELAEHIKQGVREAGGTPMEFNTVSISDGITMGSEGMKASLVSREVIADSIELVARGNLFDGLIALSGCDKTIPGTIMALERLDIPGLMLYGGSIAPGKFHAQKVTIQDVFEAVGTHARGKMSDADLEELEHNACPGAGACGGQFTANTMSMCGEFLGISPMGANSVPAMTVEKQQVARRCGHLVMELVRRDIRPSQIITRKAIENAIASVAASGGSTNAVLHLLAIAHEMDVELNIEDFDKISSRTPLLCELKPAGRFTATDLHDAGGIPLVAQRLLEANLLHADALTVTGKTIAEEAKQAKETPGQEVVRPLTDPIKATGGLMILKGNLASEGCVVKLVGHKKLFFEGPARVFESEEEAFAGVEDRTIQAGEVVVVRYEGPKGGPGMREMLGVTAAIAGTELAETVALITDGRFSGATRGLSVGHVAPEAANGGAIAVVRNGDIITLDVERRELRVHLTDAELEARLRNWRAPEPRYKRGVFAKYASTVSSASFGAVTGSTIENKTLAGSTK

SEQ ID NO: 141 - DNA, 1668 bp, Thermus thermophilus
atgaggtcggaccagatcaagaagggactcaagcaggcccccgcccgcgccatgctccgggcggtgggggtgggggacgaggacttcggaaggcccttcgtgggggtggtgaacaccttcaccgacgggatgccctgcaacttccacctgcgggagctggcccagcacctcaaggccgggctcagggaggcggggcttttcccctttgagttcggggcccccgccatctccgacgggatcagcatgggcaccccgggcatgcgggcgagcctcgtaagccgcgaggtcatcgccgacagcgtggagctcatcgcccagggctacctctacgacggcatggtggggctttccgcctgcgacaagaccatcccgggcacggccatgggggtgatccgcagcggcgtccccggcatggtcctctacggggggacgatcgcccccggggagtggcaaggccggaagctcaccatcgtggaggtctttgaggcggtggggcaaagggccgcggggaagatcagcgaggaggagcttttggagattgaacgccgggccatccccggccccggggcctgtggggggcagtacaccgccaacaccatggccatggccctcgaggccctgggcctctcccccgtgggctacaacgccatccccgccgtccaccccgaaaaggagcgggccaccaaggaggcggggaaaatcctcgcctgggccatcgcccacgactggaagcccaaggacttcctcacccggaaaagcttcctcaacgccgtcgccgccgtggccgccacgggggggagcaccaacgccgtcctccacctcctcgccctggccaaggaggcgggggtggagctcagcctggacgactttgaccagatctcccgcaagaccccggtgatcgcggacctccgcccttggggcacctacaccgcctgggagctgtatgaagccggggggacggccctcgtcttcaagcggcttctggaggcggggctcctctttggggaggagaagaccctcacgggccgcaccctggcggaggaggtggagcgggcctaccgggaacaagaggggcagaaggtggtcttccccgtggagaaggccctcaagccccacggggggctcgtggtgctcaaggggaacctcgcccctcaaggcgccgtcctcaagctcgcggggacggaacgcacctcctttgagggcccggcccgggtctttgactccgaggaggcggccatggagaaggtcctgaagggggagatccggcccggggacgtggtggtcatccgctacgtgggccccaagggggcgccggggatgcccgagatgctctcggtgacgagcgccatcgtgggggagggcctggggccggaggtggccctcctcaccgacggccgcttctccgggggcacccgcggcctcatgatcggccacatcgcccccgaggccttcgtgggcgggcccatcgccctcctggaagagggggaccgcatccggattgacgtggaaggccgccgcctcgaggtcctcctccccgaggaggagctggaaaggcggagggcccgctggcggccccgaccccccgccttcacccacggcctcttcgcccgctacgccgccctggtgcgccaggcggacgagggggcggtgctggaagacccgctctag

SEQ ID NO: 142 - protein, 555 aa, Thermus thermophilus
MRSDQIKKGLKQAPARAMLRAVGVGDEDFGRPFVGVVNTFTDGMPCNFHLRELAQHLKAGLREAGLFPFEFGAPAISDGISMGTPGMRASLVSREVIADSVELIAQGYLYDGMVGLSACDKTIPGTAMGVIRSGVPGMVLYGGTIAPGEWQGRKLTIVEVFEAVGQRAAGKISEEELLEIERRAIPGPGACGGQYTANTMAMALEALGLSPVGYNAIPAVHPEKERATKEAGKILAWAIAHDWKPKDFLTRKSFLNAVAAVAATGGSTNAVLHLLALAKEAGVELSLDDFDQISRKTPVIADLRPWGTYTAWELYEAGGTALVFKRLLEAGLLFGEEKTLTGRTLAEEVERAYREQEGQKVVFPVEKALKPHGGLVVLKGNLAPQGAVLKLAGTERTSFEGPARVFDSEEAAMEKVLKGEIRPGDVVVIRYVGPKGAPGMPEMLSVTSAIVGEGLGPEVALLTDGRFSGGTRGLMIGHIAPEAFVGGPIALLEEGDRIRIDVEGRRLEVLLPEEELERRRARWRPRPPAFTHGLFARYAALVRQADEGAVLEDPL

SEQ ID NO: 143 - DNA, 1725 bp, Maricaulis maris
atgacccacgacagacgcaaatcttcagacgccatcacagccggcgcggcccgcgccccggcccgggccatgttgcgcgcgaccggcatgacggatggtgatttcgacaagccgatgatcggggtgatcaacacctggaccacggtcacgccctgcaacatgcacctggcggacctggccgcgccagtccgcgaagccgttcgtgaagccggtggccatccggtcgacttcaacacgatcgtcgtgtccgacgggatctcgatgggtaccgaaggcatgcgtgcctcgctgatctcgcgcgaggtgatcaccgactcgattgaactggcgacccggggtcacagcctggatggcgtcgttatcctcgtcggttgtgacaagaccattccggcggccgcgatggcgctggcccgcatggatgtgcccggttgcatcctctacggcggcacgatcatgccgggcaagctgggcgatcaggccctgtccatccaggacgtgttcgaagctgtaggcgcccatgccgcggggaccctggatgatgcaggcctggacaaggtcgaaaaagcggcttgcccgggcgccggcgcctgtggcggccagtttaccgccaatacgatggccatgatcctgaccatgctgggtctgtctccgatgggcgtgaacgacattcccgccccgcaccccgacaagccggaggcggcggctcgctgcggccgactggctgtcgagctggcgaaatccggcaccaccccgcgccgtttcatcaccgaagcctcccttcgcaatgccgttgtcggcgcttccgcctcgggcgggtcgaccaatgccgtcctgcacgtcgccgcaatcgccgccgaagccggcataccgttcgacattgccgagttcgaccgtatctccagcgaagcccccgtcatcaccgacctgaagccgggcgggcgttttctggcccaccacatgttcctggccggcggctcccgcctgttcggtcagcgcctgatcgagggcggcttgctggctgataccccgactgtctccggcaagagcctgcatgaagagtgcgccagcgccgaagagtcactcaatcaacgtgtcatccaatccgttgccaacccggtcaaaccggatggtggtttccgcgtcctgaccggcgacctggcccccgaaggcgcagtcctgaaactgtcgggtcatgcccgcagcgaattttccggaccggcccgggtgttcgaatgcgaggaagacgccttcgccgccgtggaggccaactcggtcaaggctggtgacatcatcatcatccgcaatgagggccccaagggcggccccggaatgcgggaaatgctgggcgtgaccgccgccctggtcggtcagggactggccggcgatgtcgccctgatcaccgatggccgcttttccggcgcctccaagggcttcgtgatcggtcatgtcagccccgaggccgccgatggcggtccgatcggacgggtccgaaatggagacagggtgcgcattgatgtcgccgcccgccggatcgatgtcgatgccgacctgtctgcccgtccgcaatcctcgtccggccggcccgccccgaccggtgttttcgccaaatatgccgcgctggtctcttcggcctcgcgcggcgccaccaccatcatcgcgccgactgccaccaaggcgtcgccgcaaacaaccgacatgcaatccaagcaggagatgcccgcatga

SEQ ID NO: 144 - protein, 574 aa, Maricaulis maris
MTHDRRKSSDAITAGAARAPARAMLRATGMTDGDFDKPMIGVINTWTTVTPCNMHLADLAAPVREAVREAGGHPVDFNTIVVSDGISMGTEGMRASLISREVITDSIELATRGHSLDGVVILVGCDKTIPAAAMALARMDVPGCILYGGTIMPGKLGDQALSIQDVFEAVGAHAAGTLDDAGLDKVEKAACPGAGACGGQFTANTMAMILTMLGLSPMGVNDIPAPHPDKPEAAARCGRLAVELAKSGTTPRRFITEASLRNAVVGASASGGSTNAVLHVAAIAAEAGIPFDIAEFDRISSEAPVITDLKPGGRFLAHHMFLAGGSRLFGQRLIEGGLLADTPTVSGKSLHEECASAEESLNQRVIQSVANPVKPDGGFRVLTGDLAPEGAVLKLSGHARSEFSGPARVFECEEDAFAAVEANSVKAGDIIIIRNEGPKGGPGMREMLGVTAALVGQGLAGDVALITDGRFSGASKGFVIGHVSPEAADGGPIGRVRNGDRVRIDVAARRIDVDADLSARPQSSSGRPAPTGVFAKYAALVSSASRGATTIIAPTATKASPQTTDMQSKQEMPA

SEQ ID NO: 145 - DNA, 1662 bp, Parvularcula bermudensis
atgacccaaaacaaacgaagcgacgccatcaccaagggaccggcccgggccgctgcccgcgccatgctccgcgcgacgggcatgtcggacgccgatttcgacaagccgatggtggggatcatcaacacctacgcctcggtcactccctgcaatatgcatttgcgcgccctgggcgaagacgtccgcgccggtgtcgttgaggggggcggctggccggtcgagttcgggaccatcgtcgtctccgacggcattacgatgggccacgaagggatgcgggccagcctgatgtcgagggaggtgatcgccgactccatcgaactagccgtgcgcggccacgcgctcgatgcggccatcgtgctggtgggatgcgacaagaccattccggccgcagcgatggccctggcacgactcgatatccccgggatcgttttctacggcggcacgatcgcccccggctgtcacaaaggccaggatatcagcattcaggatgccttcgaagctgtcggcgcctatggccttggccggatcgatggcgacgaattgtcggcggtggaacgcgcggcttgccctggtgccggggcgtgcggtggccagttcacggcgaacactatggcgatggccatggcgtttctcggccttgcccccatgggcgccggcgaccccccggccctccatccggacaaaacgatcgaggctcggcgctgtggccaattggtggccgagaatgcccttggcaccaccgcccgcacctatgtctcgcccgagagcctccacaatgccgtctgtgccgttgtcgcctccggcggctccaccaatgcggtgctgcacctcgccgctatcgccgcggaggcgaaggtccccttctcgatcgatctgttcgaccagctttcgaggaccacgccggtgatcgcgaacctcaaaccgggggggcgttacctggcgcaggatctgttcgccgtcgggggcaatcgccggttcggcaaaatgctgatggaagcgggcgcgctgaaagatattcccacgacgagcggacgctctctctttgccgagttggccgaggcgccgccgagcgatgacaccgacgtgctgcgccctgtggacgcgccgctcaagcccaccggcgggctgcgcatcctctatggcgacgtggcgcccgacggcgccgtgctgaaaaccgccggctatggcgacggcgcctttgaggggccggcgcggatcttcgaatgtgaggaggattgcttcgcggcggttcaggccggcaccattgccgagggcgatgtcgtcgtgatccgcaatgaaggccccaaaggcggcccggggatgcgagagatgctcggcgtcacagcggccctcgccggacagggccttgcaggaaaggtcgccttgttgaccgacggccgattttcaggcgccagtcatggcttcgttatcggtcacatctcccccgaggcggcggtgggcggccccatcggcctgttgcaggagggcgaccggatttcgatcgacgccgaagggcggcgtatcgatgccgccatcgactggcaggcccgcaaagagaattataccccaaccccaaaggcgccccagggcggctatttcgacaaatatcgcgcgttggtcggctcggcgagccgcggcgccacaactctccaggaaggataa

SEQ ID NO: 146 - protein, 553 aa, Parvularcula bermudensis
MTQNKRSDAITKGPARAAARAMLRATGMSDADFDKPMVGIINTYASVTPCNMHLRALGEDVRAGVVEGGGWPVEFGTIVVSDGITMGHEGMRASLMSREVIADSIELAVRGHALDAAIVLVGCDKTIPAAAMALARLDIPGIVFYGGTIAPGCHKGQDISIQDAFEAVGAYGLGRIDGDELSAVERAACPGAGACGGQFTANTMAMAMAFLGLAPMGAGDPPALHPDKTIEARRCGQLVAENALGTTARTYVSPESLHNAVCAVVASGGSTNAVLHLAAIAAEAKVPFSIDLFDQLSRTTPVIANLKPGGRYLAQDLFAVGGNRRFGKMLMEAGALKDIPTTSGRSLFAELAEAPPSDDTDVLRPVDAPLKPTGGLRILYGDVAPDGAVLKTAGYGDGAFEGPARIFECEEDCFAAVQAGTIAEGDVVVIRNEGPKGGPGMREMLGVTAALAGQGLAGKVALLTDGRFSGASHGFVIGHISPEAAVGGPIGLLQEGDRISIDAEGRRIDAAIDWQARKENYTPTPKAPQGGYFDKYRALVGSASRGATTLQEG

SEQ ID NO: 147 - DNA, 1683 bp, Oceanicaulis alexandrii
atgaccgataacaaacgcccctcgcacacactgatccaggggccggcccgcgccccggctcgcgccatgcttcgcgcggccggctatgacgatgaccggatggcgaaacccatgatcgccatcgtcaacacctggaccagcgtcaccccgtgcaacatgcaccttcagggtctcgccgatcatgcccgcgccgggatcgaggcggcaggcggcacggcggtggatttcaacaccatcgtcgtcaccgacggcatctccatgggcaccgaaggcatgcgcgccagcctgatgagccgcgattgcgtggcggactccgccgaactcgccgtgcgcggccattgcctggacgccgtgctgttcctggtgggctgcgacaagaccctgcctggcgccgccatggcggcggcgcggctgaacctgcccagcgtcgtgctctatggcggctcgatcatgccgggcaagctgggcgacaaggcggtgacgattcaggacgtgttcgaggccgtcggggcctgcgcggcgggcaagatcagcgaagacgaactcgtcgaagtcgaaaaagccgcctgccccggcgcgggcgcctgcggcggccagttcaccgccaacaccatggcgctggcgctgaccgcgctcggcctgtcgcccatggggctcaacgacattcccgccgttcatcccgacaagcccgaagccgcgcgcaaggccggtcaggccgtggtcgatgcgctgaaggcggatcgcaagccgcgcgacatcatcaccccgacctctctgaaaaacgccgccgtcgcggtgaccgccacggcgggctccacaaacgcggtcctgcatcttctggccattgcccgcgaagccggggtcagccgggatcagttcgacattgatgtgtttgacgccgtgagccggaagactccggtgatcgccgatctcaagcccggcggtcgctatatggcgccggacatggcggctgcgggcggggcacgcctgctgctgcagcgcctgaaagccgcggacatgctggacgatgcgcccaccgtcaccggcaagaccctgtttgaagaagccgagctggccgctgaaacgccgggtcaggacgtgatcctgtcgcccgacaaaccgctcaagaagcgcggcggcttcggcgtgctttatggcgatctcgccccggaaggctgcgtcgccaagctcgcgggtcatgaccgtctgttctttgaaggccccgccaaggtatttgattgcgaggaagactgcttcgccgcggtcaattcgggcgggatcgagaagggcaatgtggtcgtcatccgcaatgaaggccccgccggcgggccgggcatgcgtgaaatgctggccgtcaccgccgccattcaaggcgcaggcctgggcgatgatgtggcgttgatgacggacggccgcttctcgggcgcgacctatggcttcatggtcgggcacgtcgcccccgaagccgcccatggcggacccatcgcctttgtgaagaccggcgatatcatcaccatcgatatcgagaaccgtcgcattgatgtgaaggccgatctcaaggcgcgcatggcccagggcttcaccccgcccgaacccaaataccgcacgggggcgttcgcgaaatacgccaggctcgtccactccgcatcagatggcgcggtgacgagcttcccgttcgactag

SEQ ID NO: 148 - protein, 560 aa, Oceanicaulis alexandrii
MTDNKRPSHTLIQGPARAPARAMLRAAGYDDDRMAKPMIAIVNTWTSVTPCNMHLQGLADHARAGIEAAGGTAVDFNTIVVTDGISMGTEGMRASLMSRDCVADSAELAVRGHCLDAVLFLVGCDKTLPGAAMAAARLNLPSVVLYGGSIMPGKLGDKAVTIQDVFEAVGACAAGKISEDELVEVEKAACPGAGACGGQFTANTMALALTALGLSPMGLNDIPAVHPDKPEAARKAGQAVVDALKADRKPRDIITPTSLKNAAVAVTATAGSTNAVLHLLAIAREAGVSRDQFDIDVFDAVSRKTPVIADLKPGGRYMAPDMAAAGGARLLLQRLKAADMLDDAPTVTGKTLFEEAELAAETPGQDVILSPDKPLKKRGGFGVLYGDLAPEGCVAKLAGHDRLFFEGPAKVFDCEEDCFAAVNSGGIEKGNVVVIRNEGPAGGPGMREMLAVTAAIQGAGLGDDVALMTDGRFSGATYGFMVGHVAPEAAHGGPIAFVKTGDIITIDIENRRIDVKADLKARMAQGFTPPEPKYRTGAFAKYARLVHSASDGAVTSFPFD

SEQ ID NO: 149 - DNA, 1605 bp, Plesiocystis pacifica
atgctgcgcgccacgggcctcgaagacgaggacctcgccaagccgctgatcgccgtggtcaacacctggagcgacgtgaccccctgcaacgtgcacctgcgcgggctcggggaggcggtccgccgcggggtccaagacgctggcggaacgcccttcgagttcaacaccatcgtcgtcagcgacggcatctccatgggcacggagggcatgcgggcgtcgctggtctcgcgggaggtcatcgccgacagcatcgagctcgccgtgcgcgggcacagcctggacgcggtcgtggtcatcgtgggctgcgacaagacgatcccggcggcggccatggccctcgcgcgcctcgatcgtccggggctggtcctctatggcggctcgatcgccaagggccggcaccggggggccgacgtcagcattcaggaggtcttcgaggccgtgggcgcctgcgcggccgggcgcatcgacgcggacgagctcgacgccatcgagcgcagcgcgtgcccgggcgcgggggcctgcgggggccagttcacggccaacaccatggcccaggtgctgaccttgctcgggctctcgcccctgggcgcgaacgacattccggccacgcacccggccaagctcgaggtcgccgaggcttgcgggcgtcaggtcctcgagctgctcgagcgcgagctccggccgagcagcttgctgaaccgggcggccttcgcccgggcgacggcgggggtggccgcgagcaagggctcgaccaacgccgtgctccacatcctcgccatcgcccgggaggccggctgcgacttctcgttgcgcgagctcgacgaggtctgcgcggcgacccccgtgctctgcgacctcaagccctcggggcgctacctggccgtcgacatgagcgaggccggcgggacggccctgctcgcccggcggctgttcgaggccgggctgtgcgaggacggggcgagcgtcgacgggccctcgctccgggccctggtcgccgacgcccccgagcgcgaggggcagcgggtgatccggccggcgagccaggccttcgcgccccggggcgggctcatggcgctgttcggcaacctggcgcccgagggctgcgtgctcaagctgccccccgagctccccgaggtgttcgagggggtcgccagggtgttcgacgacgaggactcggccttcgccgcggtgcaggccggcgccgtcgaggccggcgacgtcgtcgcgatccgctacgaggggccggccggcggcccgggcatgcgcgagatgttggcggtcacggctgccctcgtgggtcggggcctcggcgggcgcgtggcgttgatcaccgacgggcgcttttcgggggcgagccacgggctggtcatcggccacgtcgcccccgaggccgcccggggcggccccctggccaggctccgcgacggcgaccgcgtgcgcatcgacgtcgtcggccagcgcctcgacgtgctcgacgcggacttcgaggcccggcgaagcccggccgcgaaggcgcctcgctacctcaccggcgccctcgccaagttcgccgcgctggtcgactcggccagcgaaggcgccacgacttctcgtccgcagttttga

SEQ ID NO: 150 - protein, 534 aa, Plesiocystis pacifica
MLRATGLEDEDLAKPLIAVVNTWSDVTPCNVHLRGLGEAVRRGVQDAGGTPFEFNTIVVSDGISMGTEGMRASLVSREVIADSIELAVRGHSLDAVVVIVGCDKTIPAAAMALARLDRPGLVLYGGSIAKGRHRGADVSIQEVFEAVGACAAGRIDADELDAIERSACPGAGACGGQFTANTMAQVLTLLGLSPLGANDIPATHPAKLEVAEACGRQVLELLERELRPSSLLNRAAFARATAGVAASKGSTNAVLHILAIAREAGCDFSLRELDEVCAATPVLCDLKPSGRYLAVDMSEAGGTALLARRLFEAGLCEDGASVDGPSLRALVADAPEREGQRVIRPASQAFAPRGGLMALFGNLAPEGCVLKLPPELPEVFEGVARVFDDEDSAFAAVQAGAVEAGDVVAIRYEGPAGGPGMREMLAVTAALVGRGLGGRVALITDGRFSGASHGLVIGHVAPEAARGGPLARLRDGDRVRIDVVGQRLDVLDADFEARRSPAAKAPRYLTGALAKFAALVDSASEGATTSRPQF

SEQ ID NO: 151 - DNA, 1713 bp, Bacillus sp.
ttgggaagagatcttagaataaaaagccatgtaatcagcgaggatgaaaggcgcgcaccaaaccgggcgatgctgcgggcagtagggttcacggatgaagatttcaaaaagccgatgatcggcattgcaagcacatggagcgaagtgactccgtgcaatatacatatcaatgaacttgcattcaaggcgaaggacggtgccagggaagccgggggagctccgcttgtattcaatacgattactgtttctgacggaatctccatgggaacagaggggatgaggtattcccttccgagccgcgacctgattgctgattccattgaaacggtcgttgggggtgaaagcctggacggctttgttgccattggaggctgcgataaaaatatgcccggctgcctgatggccatcgcaaggatgaacctgcctgctgtttttgtgtatgggggcacaatcaagcctggcaagctgcagggacaggatatcgatattgtgtcagtatttgaaggggtaggacagttcaatggtggggccattgataaagctggactcaatgagatcgaatgccatgcatgtccgggggccggctcctgcggcggaatgtacacagccaatacgatggcaagcgctatcgaggcgctgggaatgagccttccgggcagttcctccaatccggcagaaacagatgaaaagcggcaggattgccatgaagcaggaaaggcagtctaccgccttttggagcaggatatcaggccaagggatattcttacgaaggaagcgtttgagaatgcaattactgtcgtgatggctttgggcggttcgacaaatgccatcctccatttgatggccatcgcccattctgctgaagtggatctgtcacttgaggacttcaaccgccttcagaaaacggtcccccatatagccgatttaaagccgagcggaaaatatgtcatgcagaatctccatgaagcaggaggagtcagtgcagttatgaaaatgctgctgagggaagggctgcttcacggcgattgtctgactgtgacgggcaagacgctcgctgaaaatctggaagaagcagaagatctgaaagctggccaaaaggtcatttacccgcttaatgcccctcttcgggaaaacgggccgcttgtagtcctgaaaggcaatcttgccccggaaggcgccgtagcgaaggtatccggcctgaaggtcaccaggcacaccgggcctgccaaggtgtttgatgatgaggagtctgctacagatgctgtcctgaagggtgacattcaggctggtgatgtactggttatcaggtacgaagggccaaaaggcgggcctggcatgccggaaatgctttctatttcgggcatcctcgtaggaaaaggtcttggcgaaagtgtggccctgctgacagacgggcgtttctcgggaggtacccatggccttgtggtaggacatatcgctccggaagcacaggtcggcggaccgattgccctaatacagacaggtgacaggattactattgacagcaccgaacagacacttgaagtggatgtctctcctgctgaactggaagagaggaagaaatcctgggatccgccgccgcttttaacccgcggagccctggctaagtatacaaggctcgtttcctccgcttcaaggggggctgtcactgaccattttgaggaagagcctgctgccaggccgcttaaagtgtag

SEQ ID NO: 152 - protein, 570 aa, Bacillus sp.
MGRDLRIKSHVISEDERRAPNRAMLRAVGFTDEDFKKPMIGIASTWSEVTPCNIHINELAFKAKDGAREAGGAPLVFNTITVSDGISMGTEGMRYSLPSRDLIADSIETVVGGESLDGFVAIGGCDKNMPGCLMAIARMNLPAVFVYGGTIKPGKLQGQDIDIVSVFEGVGQFNGGAIDKAGLNEIECHACPGAGSCGGMYTANTMASAIEALGMSLPGSSSNPAETDEKRQDCHEAGKAVYRLLEQDIRPRDILTKEAFENAITVVMALGGSTNAILHLMAIAHSAEVDLSLEDFNRLQKTVPHIADLKPSGKYVMQNLHEAGGVSAVMKMLLREGLLHGDCLTVTGKTLAENLEEAEDLKAGQKVIYPLNAPLRENGPLVVLKGNLAPEGAVAKVSGLKVTRHTGPAKVFDDEESATDAVLKGDIQAGDVLVIRYEGPKGGPGMPEMLSISGILVGKGLGESVALLTDGRFSGGTHGLVVGHIAPEAQVGGPIALIQTGDRITIDSTEQTLEVDVSPAELEERKKSWDPPPLLTRGALAKYTRLVSSASRGAVTDHFEEEPAARPLKV

SEQ ID NO: 153 - DNA, 1686 bp, Oceanobacillus iheyensis
atgggaaaagatttgcggataaaaagtaaagcatttgacggtactatgcgagctccaaatagggcaatgcttcgtgcggtcggtctgacagatgaagattttaagaagcctatgattggtgtagcaagtacatgggcagaagtaacaccatgtaatatacatttaaatgatttagctcttcttgccaaaaaaggggtccggcactcggatgctgttcctttggtctttaatacgataaccgtatctgatggaatttccatgggaacacaaggtatgaactactcattgccgagtcgagatcttattgctgattcaatcgaaaccgttgttggagcagaaaatttagatggattagtagcaattggagcctgtgacaagaatattccagggtgcttgattgcgattgctaatgcaggagttccctcggtatttgtatatggcggaacaattgccccaggaaatgtggatgggaaagatatagatattgtttcagttttcgaaggagtaggacaacataatgcaggagctattgacgataatcaattaagaaaagtagaatgtaatgcttgtccaggtgcaggagcatgtggtggaatgtataccgccaatacaatggcctctgcagcggaagctttaggaatcagtttaccgggaagctcttctaacccagctgaatcagaagaaaagcagggtgatgtggaggcagctggtgaagcgattaaagatttattagagaaaggtatttatccaaaagatattctaacgaaaaaagcttttgaaaatgcaattacagtagttatggcattgggaggatctacaaatgcgatcttgcatttactagcagtttctcatgccgcagaagtagacttaacgattgatgattttaatcgaatccagaaaaaagtaccgcatttagccgatttaaaaccaagtggacgttttgtaatgcaagaccttcatcgagttggtggggtacaagcagtaatgaaattattgcatgaaaatggatacttacatggcgactgtcttactgtaacaggaaagactatagcagaaaatctagctgaagctcctgctttgaaagaaaatcaacaagtcattatgccgtttgataatccaaaaagggaagatggtcctctgattgtcttaaaggggaatttatcaccaactggtgctgtggcaaaagtatcaggggtgaaagtgaaacgacacacaggtcctgcacgtgtattcaacacagaaaaagaggcaactcaagcaattctggataacaaaattaaagagggagatgtattagttattcgttatgttggaccaaaaggtggtcccggaatgccggagatgttgtctgtttctagtattcttgtaggtaaaggaatgggagaatcggtagctttattgacggatggtagattctctggtggtacacatggtcttgtggtaggtcatataagtccagaggcacaagatggcggaccaattgcatttctgcaagaaggagatatggtgaccatagattctaataaaagagaaatttccatggacgtttcggaagatgaaataaaactacgtcaaggaaaatgggaagcccctgaactacataagaaaggggttcttggaaaatatgcacataatgttacttgctcatccaaaggtgcagtaacagattatttgaaccgagaataa

SEQ ID NO: 154 - protein, 561 aa, Oceanobacillus iheyensis
MGKDLRIKSKAFDGTMRAPNRAMLRAVGLTDEDFKKPMIGVASTWAEVTPCNIHLNDLALLAKKGVRHSDAVPLVFNTITVSDGISMGTQGMNYSLPSRDLIADSIETVVGAENLDGLVAIGACDKNIPGCLIAIANAGVPSVFVYGGTIAPGNVDGKDIDIVSVFEGVGQHNAGAIDDNQLRKVECNACPGAGACGGMYTANTMASAAEALGISLPGSSSNPAESEEKQGDVEAAGEAIKDLLEKGIYPKDILTKKAFENAITVVMALGGSTNAILHLLAVSHAAEVDLTIDDFNRIQKKVPHLADLKPSGRFVMQDLHRVGGVQAVMKLLHENGYLHGDCLTVTGKTIAENLAEAPALKENQQVIMPFDNPKREDGPLIVLKGNLSPTGAVAKVSGVKVKRHTGPARVFNTEKEATQAILDNKIKEGDVLVIRYVGPKGGPGMPEMLSVSSILVGKGMGESVALLTDGRFSGGTHGLVVGHISPEAQDGGPIAFLQEGDMVTIDSNKREISMDVSEDEIKLRQGKWEAPELHKKGVLGKYAHNVTCSSKGAVTDYLNRE

SEQ ID NO: 155 - DNA, 1695 bp, Staphylococcus saprophyticus
ttgactaaagaacacagcgaacaacaaaaagatttacgtattcgcagcaaagtaattagtgaaggtgtcagtcgtacacccaatcgagcttatttacgggcactcggctttgaagatgaagattttcaaaaaccaatgattggtgttgcaagtacttggagtgaagtcacgccatgtaatatgcatattgatggtttagctcgtgcttcaaaacaaggcattagtgaggcaggtgcttcgccacttattttcaataccattacagtatcagatggtatttcaatgggaacagacggtatgcgcttctctttaccaagtcgtgaaattatcgcggattctatagaatcagttgtcagtgctgaaaatttagatgcacttgtcgctattggtggttgtgacaaaaacatgccgggatgtatgattggtatcgctcgtcttaatttaccagctgtctttgtttatggcggcacaatattgcctgggaaattggatggtaaagatttagatgctgtttctgcctttgaaggcgtcggacagtataataatggcgaaatagataaagaggcacttcacaaagtagaatgtgccgcttgtccaggggccggtgcttgtggtggtatgttcactgccaatacgatgtcatctgctattgaggccatgggcatgagtttaccaggaagtgcttcgcatccagcagtttctacaaataaatccaaagacagcagagcagcaggtaaagccgtttataaactattagaaaaaggcatctatccaaaagatattatgactaaagaagcatttgaaaatgcaattactgtagtcatggcacttggaggatctaccaatgcaattttacatttacttgctattgcacatacaatcgaagtcgatttaacacttgatgatttcgaaaaaattcgtaagcgtgtcccacatatcgctgacttgagaccaagtggtaaatatgtcatggcacatcttgatgaagtcggtggtattccagcagttatgaaattattacatgacaaaggcttaatccatggagattgcttgaccgtaactggcaagactgttgctgaaaaccttgaacaacaacctgacctaaccgataataaatctatcattgattttgacaatccaaaacatgctactggaccgcttgttatcttgaaaggaaatcttgccccagaaggcgccgttgcaaaaatctcaggtctgagcgtaacttatatcaaaggacccgcacgcgtatttgattccgaatctaaggctaccaaagccatcttaaatgacgaaatcaaaccaggtgacgtggtcgttattcgatatgctggccctaaaggtgcacctggcatgcctgaaatgctatctgcatcatccattcttgtgggtaagggattaggtgaatctgtagcgttactcacagatggccgtttctctggcggttctcatggtcttgttatcggacacgcagcgccagaatcacaagttggcggtccgatggcattattagaagaaaacgacacgattaccattgacgcagaaaaacttgaaattagttttgatgtatcagacgaagaacttgagcgtcgtaacaaacaatggcaagcaccacctttaaaagccaatcgaggtacgctagctaagtatgctaagcttgtgtcatccgcttcaaaaggagctatcacagactaa

SEQ ID NO: 156 - protein, 564 aa, Staphylococcus saprophyticus
MTKEHSEQQKDLRIRSKVISEGVSRTPNRAYLRALGFEDEDFQKPMIGVASTWSEVTPCNMHIDGLARASKQGISEAGASPLIFNTITVSDGISMGTDGMRFSLPSREIIADSIESVVSAENLDALVAIGGCDKNMPGCMIGIARLNLPAVFVYGGTILPGKLDGKDLDAVSAFEGVGQYNNGEIDKEALHKVECAACPGAGACGGMFTANTMSSAIEAMGMSLPGSASHPAVSTNKSKDSRAAGKAVYKLLEKGIYPKDIMTKEAFENAITVVMALGGSTNAILHLLAIAHTIEVDLTLDDFEKIRKRVPHIADLRPSGKYVMAHLDEVGGIPAVMKLLHDKGLIHGDCLTVTGKTVAENLEQQPDLTDNKSIIDFDNPKHATGPLVILKGNLAPEGAVAKISGLSVTYIKGPARVFDSESKATKAILNDEIKPGDVVVIRYAGPKGAPGMPEMLSASSILVGKGLGESVALLTDGRFSGGSHGLVIGHAAPESQVGGPMALLEENDTITIDAEKLEISFDVSDEELERRNKQWQAPPLKANRGTLAKYAKLVSSASKGAITD

SEQ ID NO: 157 - DNA, 1752 bp, Bacillus selenitireducens
atgatagacgttatatggcatgtgagattatgtacattgacagaaagggtgaatgttgtgagtgagaaggatttgcgtcataaaagtaaagtgatcagtgaaggggtaaaccgggttccgaaccggtcaatgctgcgtgcagtcgggtttaccgatgaggatttcaagaaaccgatgattggggttgcgagtacgtggagtgaggtcaccccttgtaatgtacatattgatgccttggcaagagatgccaagctcggagcggcagaaggcggcggagcgccgatgatcttcaatacgatcatggtcgctgacgggattgcgatggggcatgaaggcatgagctattccctgccgtcaagggaagtcatcgccgattccattgaaacggttgtcggagcagaagccctcgacgccgtcgtcgccattggcggttgtgacaaaacaacgccgggctgtctcatttccatgggacggatgaatgtaccgggcgtctatgtgtatggcggtacgatcaaaccggggaaactcgatggcaaggacatcgacatcgtcaactccttcgaggcagtcggtcagtaccagagcggcaagcttgatgaggaaggccttcataaagtggaatgttctgcctgccctggaccgggttcctgcggcgggatgtacacggcaaatacaatggccgcagcggcagaagcgctcggcatgagtattccaggctcatcatcgacgcctgcagtggatgattataagcatcaggagtgcaggcaggccggcgatctgacggttcagcttttggaaaaagacatcaagccccgtgatattatgacgaagaaggcgtttgagaatgccattaccgtcgtcatggccctcggcggctcaacaaatgccttcctgcatcttcttgcgattgcgagaagcgttgacgtcgacttgacgtatgatgactttgaacgggtccgcaagaacgtcccgcatattgccgatctgaagccaagcggtcagtatgtcatggaagacctcttccaggcagggggcgtgcctggcgtgatgaagctgcttcttgaagccggcctcctacatggcgactgcatgacggtaactggcaagacgattgccgagaaccttgcagctgcggaaccgctgaaagaaggacaaaaagtgatttttccgcttgataagccgattaagccaagcggtccattgattgtcatgaaagggaatctggcccctgaaggcggggttgccaagatgagcggtcagtcgatcagtcattttgaaggtacgatcaaagtgtatgacagtgaggccgatgcgacgaaggccattgaagcgggagagatcgttgagggggatgtcctcgtcatccgctatgtgggtccaaaaggcggtccgggtatgccggagatgctctcgatcacggcgatgatcgtaggtcgaggcttgaacggtaaagtcgcactgatgacagatggccgattctccggcggttcacacggctttgttatcggtcatattgcaccggaagccgcagtaggcgggccgattgcgctgatcaagaatggtgacaaggtcacgatcgatgcggatacgcaggagatcaatctgcatattgatgaagcggagtttgagaagcggaaacaggaatggcagccgaagccgccgcggtttacgtacggcgtgttgaagaaatatgccaaactcgtttcgtcttcagcggaaggcgcaattacagacggtaaagaagccgattga

SEQ ID NO: 158 - protein, 583 aa, Bacillus selenitireducens
MIDVIWHVRLCTLTERVNVVSEKDLRHKSKVISEGVNRVPNRSMLRAVGFTDEDFKKPMIGVASTWSEVTPCNVHIDALARDAKLGAAEGGGAPMIFNTIMVADGIAMGHEGMSYSLPSREVIADSIETVVGAEALDAVVAIGGCDKTTPGCLISMGRMNVPGVYVYGGTIKPGKLDGKDIDIVNSFEAVGQYQSGKLDEEGLHKVECSACPGPGSCGGMYTANTMAAAAEALGMSIPGSSSTPAVDDYKHQECRQAGDLTVQLLEKDIKPRDIMTKKAFENAITVVMALGGSTNAFLHLLAIARSVDVDLTYDDFERVRKNVPHIADLKPSGQYVMEDLFQAGGVPGVMKLLLEAGLLHGDCMTVTGKTIAENLAAAEPLKEGQKVIFPLDKPIKPSGPLIVMKGNLAPEGGVAKMSGQSISHFEGTIKVYDSEADATKAIEAGEIVEGDVLVIRYVGPKGGPGMPEMLSITAMIVGRGLNGKVALMTDGRFSGGSHGFVIGHIAPEAAVGGPIALIKNGDKVTIDADTQEINLHIDEAEFEKRKQEWQPKPPRFTYGVLKKYAKLVSSSAEGAITDGKEAD

SEQ ID NO: 159 - DNA, 1704 bp, Streptococcus pneumoniae
atgactgaattagataaacgtcaccgcagtagcatttatgacagcatggttaaatcacctaaccgtgctatgcttcgtgcgactggtatgacagataaggactttgaaacaccgattgtgggagtgatttcgacttgggcggaaaatacaccatgtaacattcacttgcatgatttcgggaaactggctaaagaaggtgtcaaatctgcaggcgcttggcctgtacagtttggaaccattaccgtagcagacgggatcgctatgggaacgcctggtatgcgtttctctctaacatctcgtgacatcatcgcggactccatcgaggcggctatgagtggtcacaacgtggatgcctttgtcgctatcggtggctgtgacaagaacatgcctggatctatgattgctattgctaatatggatatcccagctattttcgcctatggtggaactattgcaccgggaaatcttgatggtaaagatatcgacttggtttctgtctttgaaggtatcggaaaatggaaccacggtgacatgacagctgaggacgtgaaacgtcttgaatgtaatgcctgccctggccctggtggctgtggtggtatgtatactgctaataccatggcaactgctatcgaagttctagggatgagtttgccagggtcatcctctcacccagctgaatcagctgataagaaagaagatatcgaagcagcaggacgtgctgttgttaagatgttggaacttggtctcaaaccatcagatatcttgactcgtgaagcctttgaagatgctattactgtaacgatggctctcggtggttctacaaacgccactcttcacttgctcgccattgcccatgccgcaaatgttgacttgtcacttgaggacttcaatacgattcaagaacgtgtgcctcacttggccgacttgaaaccatctggtcagtatgtcttccaagacctctacgaagtcggtggtgtccctgcggttatgaagtacttgttggcaaatggtttccttcacggagatcgcatcacatgtactggtaagactgtagctgaaaacttggctgactttgcagacttgactccaggccaaaaagttatcatgccacttgaaaatccaaaacgtgcggatggtccgcttatcatcttgaacgggaaccttgctcctgacggtgcagttgccaaggtatcaggtgttaaagtgcgtcgtcacgttgggccagctaaggtctttgactcagaagaagatgcgattcaggccgttctgacagatgaaatcgttgatggcgatgtagtcgttgttcgttttgttggacctaaaggtggtcctggtatgcctgagatgctgtcactttcttcaatgattgttggtaaaggtcagggagataaggtggccctcttgacggacggacgtttctctggtggtacttatggtctggttgttggacatatcgctcctgaagctcaggatggtggaccaattgcctatctccgtaccggcgatatcgttacggttgaccaagataccaaagaaatttccatggccgtatccgaagaagaacttgaaaaacgcaaggcagaaacaaccttgccaccactttacagccgtggtgtcctcggtaaatatgcccatatcgtatcatctgcttcacgcggagccgtgacagacttctggaatatggacaagtcaggtaaaaaataa

SEQ ID NO: 160 - protein, 567 aa, Streptococcus pneumoniae
MTELDKRHRSSIYDSMVKSPNRAMLRATGMTDKDFETPIVGVISTWAENTPCNIHLHDFGKLAKEGVKSAGAWPVQFGTITVADGIAMGTPGMRFSLTSRDIIADSIEAAMSGHNVDAFVAIGGCDKNMPGSMIAIANMDIPAIFAYGGTIAPGNLDGKDIDLVSVFEGIGKWNHGDMTAEDVKRLECNACPGPGGCGGMYTANTMATAIEVLGMSLPGSSSHPAESADKKEDIEAAGRAVVKMLELGLKPSDILTREAFEDAITVTMALGGSTNATLHLLAIAHAANVDLSLEDFNTIQERVPHLADLKPSGQYVFQDLYEVGGVPAVMKYLLANGFLHGDRITCTGKTVAENLADFADLTPGQKVIMPLENPKRADGPLIILNGNLAPDGAVAKVSGVKVRRHVGPAKVFDSEEDAIQAVLTDEIVDGDVVVVRFVGPKGGPGMPEMLSLSSMIVGKGQGDKVALLTDGRFSGGTYGLVVGHIAPEAQDGGPIAYLRTGDIVTVDQDTKEISMAVSEEELEKRKAETTLPPLYSRGVLGKYAHIVSSASRGAVTDFWNMDKSGKK

SEQ ID NO: 161 - DNA, 1719 bp, Streptococcus sanguinis
atgaaagggaaagctatgacagataaggatattcgtcacagaagtaagatttatgacagtatggttaaatctcctaaccgtgccatgcttcgcgcgacggggatgactgataaagattttgaaacgcctattgttggggtgatttccacttgggcggaaaatacaccctgtaacatccatttgcatgacttgggcaagctagccaaggaaggtatcaaagcagagggcgcttggcctgttcagtacgggactattacggttgcggacggaattgccatgggaacgccgggtatgcgcttctctctgacctcacgcgatatcatcgcagactccatcgaggctgccatgggcgggcataatgtggatgctttcgtagctatcgggggctgtgataaaaatatgccaggctccatgattgccattgccaatatggatattcctgctgtctttgcctacggcggaacgattgcgccagggaagctggacggtaaggacattgacttggtttctgtctttgaaggaatcgggaaatggaaccatggtgatttgacggctgaggaagtacgacgcattgagtgtaatgcctgccctggccctggtggctgtggtggtatgtatacggccaatactatggcgacggctattgaagttctgggtatgagcctgccaggctcctcttctcaccctgctgagtctaaagacaagcaagaggatatcgaagcagctggtcgtgctgttgtgaaaatgctgaaaatggggctgaagccgtctgacatcttgacacgtgaagcctttgaagatgcaatcacggtgaccatggctctgggtggttctactaatgctaccctgcacttgctggccatggcgcacgcggccaatgttgagctgacgcttgatgactttaatgtcattcaagagaaggtaccgcatttggctgacttgaaaccatctggtcagtatgtcttccaagacctttatgaggttggtggggtaccggctgtgatgaaatatctcttggcgaacggcttcctgcatggtgatcgcatcacttgtacaggtaagactgttgcagagaatctggtagaatttgctgatctgacaccaggtcaaaaggtcattatgccgcttgaaaatccaaaacgtgcggacggtccgctcattatcttgcatggtaatctggctccagatggtgctgttgccaaggtttctggtgttaaagtgcgccgtcacgttggaccggctaaggtctttgactcagaagaagcagctattgatgctgtactggccgatgaagtggtcgatggcgatgtggtcgtggttcgctatgttggaccaaagggtggccctggtatgccagaaatgctgtcactttcttctatcatcgtagggaaaggtcaaggggacaaggtggcacttctaactgacggccgcttctcaggcggtacttacggcttggttgtcggacacattgctccggaagctcaggatggtggcccgattgcctatcttcgtacaggcgatatggtcacggttgaccaagataccaaggaaatctctatggcagtctctgacgaagagctggcgaaacgtaaggcagaaacgactattccaccgctttatagtcgcggggtacttggtaaatatgctcacatggtatcgtctgccgctaaaggtgctgttactgacttctggaaaccagaagaaacaggtaagaaatag

SEQ ID NO: 162 - protein, 572 aa, Streptococcus sanguinis
MKGKAMTDKDIRHRSKIYDSMVKSPNRAMLRATGMTDKDFETPIVGVISTWAENTPCNIHLHDLGKLAKEGIKAEGAWPVQYGTITVADGIAMGTPGMRFSLTSRDIIADSIEAAMGGHNVDAFVAIGGCDKNMPGSMIAIANMDIPAVFAYGGTIAPGKLDGKDIDLVSVFEGIGKWNHGDLTAEEVRRIECNACPGPGGCGGMYTANTMATAIEVLGMSLPGSSSHPAESKDKQEDIEAAGRAVVKMLKMGLKPSDILTREAFEDAITVTMALGGSTNATLHLLAMAHAANVELTLDDFNVIQEKVPHLADLKPSGQYVFQDLYEVGGVPAVMKYLLANGFLHGDRITCTGKTVAENLVEFADLTPGQKVIMPLENPKRADGPLIILHGNLAPDGAVAKVSGVKVRRHVGPAKVFDSEEAAIDAVLADEVVDGDVVVVRYVGPKGGPGMPEMLSLSSIIVGKGQGDKVALLTDGRFSGGTYGLVVGHIAPEAQDGGPIAYLRTGDMVTVDQDTKEISMAVSDEELAKRKAETTIPPLYSRGVLGKYAHMVSSAAKGAVTDFWKPEETGKK

SEQ ID NO: 163 - DNA, 1719 bp, Streptococcus thermophilus
atggaggaaaacatcgtgtctgaaaataacatgaaacaccgttcttctgtctacgatagcatggttaaatcacctaaccgtgctatgcttcgtgcgactgggatgacggatgatagttttgaaaagcctattgttggggttatctcaacttgggctgagaacacgccatgtaatatccacttgcacggttttggtcaaattgccaaagagggtgtcaaagatgcgggtgcttggccagttcaatttggtacaattaccgttgcagatggtattgccatggggacaccagggatgcgtttctcattgacatctcgtgatattattgctgactcaatcgaagctgctatgggtggtcacaatgtcgatgcctttgttgctattggtggctgtgataagaacatgccaggttcaatgattgctattgccaacatggatattccagctatttttgcttacggtggtacgattgcaccgggtaatcttaacggtaaggatatcgacttggtttctgttttcgaaggtatcggtaaatggaaccacggagatatgactgccgaagaggttaaaaatcttgaatgtaatgcttgccctggccctggtggttgtggtggtatgtatactgctaacacaatggcaacagcaattgaggttatggggatgagccttccaggatcatcatctcaccctgcagaatcagctgagaagaaggctgatatcgaagaagcaggtcgtgcagttgtaaaaatgctagaaatgggacttaagccatcagatatcttgacacgtgaagcctttgaagatgccatcacagttacaatggcgcttggtggttcaacaaatgccactcttcacttgcttgctatcgctcatgcggctaacgttgatttaacgcttgaagacttcaacgatttccaagagcgcgtgcctcacttggctgacttgaagccttcaggtcaatatgtcttccaagacctttacaatgttggtggtgtgccagccgttatgaaatatcttcttaagaatggttttcttcacggtgatcgtatcacgtgtactggtaagactgttgcagaaaatttggaagctttcgatgatttgacaccaggtcaaaaagttatcatgccacttgaaaatcctaaacgtgccgatggtccattgattatcttgaaaggtaacttggccccagaaggtgctgttgccaaagtatcaggtgttaaagtgcgtaacattactggtcctgctaaagtatttgactcagaagaagatgccatcgaggcagttctttctgacgaaatcgttgacggcgatgtagttgttgtacgttttgtaggtcctaagggtggtcctggtatgccagaaatgttgtcattgtcatcaatgattgttggtaaaggacaaggagacaaggttgccctcttgactgatggacgtttctcaggtggtacttacggacttgttgtaggtcatattgctcctgaagctcaagttggtggaccgattgcctacctccgtacaggtgatatggttacagttgaccaggataccaaagaaatcactatgcatgtaccagacgaagagttggcgaaacgtaaagcagaaactgagttaccaccactttatagccgtggtgtcctcggtaagtatgctcacatcgtttcatcagcatcacgtggtgcggttactgacttctggaatatggataaatcaggtaaagcttaa

SEQ ID NO: 164 - protein, 572 aa, Streptococcus thermophilus
MEENIVSENNMKHRSSVYDSMVKSPNRAMLRATGMTDDSFEKPIVGVISTWAENTPCNIHLHGFGQIAKEGVKDAGAWPVQFGTITVADGIAMGTPGMRFSLTSRDIIADSIEAAMGGHNVDAFVAIGGCDKNMPGSMIAIANMDIPAIFAYGGTIAPGNLNGKDIDLVSVFEGIGKWNHGDMTAEEVKNLECNACPGPGGCGGMYTANTMATAIEVMGMSLPGSSSHPAESAEKKADIEEAGRAVVKMLEMGLKPSDILTREAFEDAITVTMALGGSTNATLHLLAIAHAANVDLTLEDFNDFQERVPHLADLKPSGQYVFQDLYNVGGVPAVMKYLLKNGFLHGDRITCTGKTVAENLEAFDDLTPGQKVIMPLENPKRADGPLIILKGNLAPEGAVAKVSGVKVRNITGPAKVFDSEEDAIEAVLSDEIVDGDVVVVRFVGPKGGPGMPEMLSLSSMIVGKGQGDKVALLTDGRFSGGTYGLVVGHIAPEAQVGGPIAYLRTGDMVTVDQDTKEITMHVPDEELAKRKAETELPPLYSRGVLGKYAHIVSSASRGAVTDFWNMDKSGKA

SEQ ID NO: 165 - DNA, 1716 bp, Streptococcus suis
atgaccgatacaaacaaacttaaagactttcgacatcgcagctctgtttacgattcgatggtcaaatcgcccaaccgtgctatgttaagagcaacaggaatgaccgacgatagctttgaaaagcctattgttggggttatttcgacatgggctgaaaacacaccctgtaacatccaccttcatgactttggaaaattagccaaagaaggtgtcaaggaagcaggtgcctggcctgtccaatacggtaccatcaccgttgcagacggaatcgctatgggaactcctggtatgcgcttctccttgacttcacgtgatatcattgcagattctattgaggcagctatgggagggcacaacgtggatgcctttgtcgcaatcggtggctgtgataaaaacatgcctggttctatgattgctatcgccaatatggatatccctgctgtttttgcctacggcggaaccattgcgccaggtaatctcaatggtaaagacatcgacttggtatccgtttttgaaggaatcggaaaatggaacaacggtgacttgaccgctgaagaggttcgtcaaatcgagtgtaacgcttgccctggacctggtggttgcggtggtatgtacactgccaataccatggcgacagccattgaggtaatgggcatgtctattcctggctcttcttctcaccctgctgaatctcctgagaagaaggctgatattgaagaagctggtcgtgctgttgtacgcatgctagaacttggcatcaaaccatctgacattatgacgcgtgaagcctttgaagatgccattacagtcacaatggctctgggcggctcaaccaacgctactctgcacttgctggccattgcccatgctgccaacgttgatttgaccttggaagatttcaacgatttccaagagcgtgtgcctcatttggccgacttaaaaccatctggtaaatatgttttccaagacctctataatgtcggcggtgtccctgcggttatgaaatacttgctcaaaaacggcttccttcatggcgaccgcatcacatgtacaggtaaaaccgttgctgaaaacctaaagaattttgcagacttgactccaggtcaagatgtcatcatgccacttgaaaatccaaaacgagcggatggacctctgattatcttgaaaggtaaccttgctcctgaaggtgccgttgccaaggtttctggtgtgaaagtccgcaaccatacaggtccagccaaggtctttgattctgaagaagaagctatcgaagcagtcttgactgacgaaatcgtagatggcgatgtagtcgttgtccgctatgttggaccaaaaggcggtcctggtatgcctgaaatgctgtccctttcttctatgattgtcggaaaaggccaaggtgacaaggtagcccttctaacagacggtcgtttctctggtggtacctatggactggttgtgggacacatcgcacctgaagctcaggatggtgggccaattgcctacctccgtactggtgatttggtgacggttgatcaagataccaaagaaatcaccatgcacgtttctgaccaagaaatcgaagaacgcaagaaaacaactgttattccaccactctactctcgtggcgttctcggaaaatacgcccacactgtatcctctgcctctaaaggagccgttaccgacttctggagaccagaacgtacggggaaaaaataa

SEQ ID NO: 166 - protein, 571 aa, Streptococcus suis
MTDTNKLKDFRHRSSVYDSMVKSPNRAMLRATGMTDDSFEKPIVGVISTWAENTPCNIHLHDFGKLAKEGVKEAGAWPVQYGTITVADGIAMGTPGMRFSLTSRDIIADSIEAAMGGHNVDAFVAIGGCDKNMPGSMIAIANMDIPAVFAYGGTIAPGNLNGKDIDLVSVFEGIGKWNNGDLTAEEVRQIECNACPGPGGCGGMYTANTMATAIEVMGMSIPGSSSHPAESPEKKADIEEAGRAVVRMLELGIKPSDIMTREAFEDAITVTMALGGSTNATLHLLAIAHAANVDLTLEDFNDFQERVPHLADLKPSGKYVFQDLYNVGGVPAVMKYLLKNGFLHGDRITCTGKTVAENLKNFADLTPGQDVIMPLENPKRADGPLIILKGNLAPEGAVAKVSGVKVRNHTGPAKVFDSEEEAIEAVLTDEIVDGDVVVVRYVGPKGGPGMPEMLSLSSMIVGKGQGDKVALLTDGRFSGGTYGLVVGHIAPEAQDGGPIAYLRTGDLVTVDQDTKEITMHVSDQEIEERKKTTVIPPLYSRGVLGKYAHTVSSASKGAVTDFWRPERTGKK

SEQ ID NO: 167 - DNA, 1716 bp, Streptococcus mutans
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatga

SEQ ID NO: 168 - protein, 571 aa, Streptococcus mutans
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 169 - DNA, 1683 bp, Leptospira borgpetersenii
atgagcgatatattaaaaaaaagaagttcgatgactacggacggagataaccgcgcgcccaatcgagcgatgcttcgcgcggtcggctttacggacgaagatttccacaaacctatgatcggaatcgcttccacatggagcgaagtgacgccttgtaatattcatatcaataagttggccgaaaaagtcaaagagggcgttcgtacggcgggaggagttcctcaaatttacggaaccatcacggtttccgacggaattacgatgggtcacgaagggatgcatttttcacttccctccagagaagtgattgcggattcaatcgaaatcgtttccaacgcgatgagacacgacggagtgatcgcgatcggaggttgtgataagaacatgcccggatgtctcatggctctttgcagaatcgatgctccttctattttcgtttacggggggaccattcttccggggcattgcgacggtcaagacgtggatatcgtttccatcttcgaagctgttggtaaatttaatgcaggtaaaatttcaagagaagaattcattcgaatcgagcagaacgcgtgtcccggcgcaggaagttgcggggggatgtataccgcaaatacgatgtcctccgcgatagaagctcttgggatgagtctgccaggttcggcttccatgcccgcggtgagttctagaaaatcggaggattgttacgaggcgggaaaagctctcatcaatctcattcaaaagggagtcactccgaagcgaattcttaccaaaaaagcttttgagaacgcgatcaccgtagtgcttgtgttaggcggttcaaccaatgcggtccttcatttgattgcgatcgcgaaagagattggtgtggatcttactctcgaagactttgatcgaatcagtaaaaaaactcctcaccttgcggatttgaaaccgggtggtagatacgccatgaccgatctcgacaaagtgggcggggttcatggtgtgatgaagtatcttttgaaagaaggaatgcttcatggtgattgtcttacggttacgggaaaaacaattgcagaaaatctaatggatatgcccgatctcgttccaaaccagacgatcgtccgtaaaaaatcggaggcgctccatccttccggtcctcttgtgattttgaaaggaaaccttgccccggaaggtgcggttgctaaaatttccggtttgaagaaaatttccatcacgggcccggcgaaagtgttcgaatccgaagacgattgtttcaatgcgatcatgacggatcaaattaaaccgggcgacgtgattatcattcgttacgaaggtcccaaaggtggtcccgggatgagagagatgctcgcggtaacttcggcgcttgtcggaaaaggtttgggagaagacgtgggtctgatgacagacggtcgattcagtggaggaacgcacggtctcgtagtcggtcatatttctcccgaagcatttgatggaggtccgattgcgatcgttcaaaatggggatgcggttactatcgattccggtaaaaatttgctccaagttgaaatttctcaggaagaaattcagaaacggctaaaaaattggaaaccgattgaaccgagatataaatccggggttcttgcgaaatacgcaaaactggttcaatcggcgactaacggagcgattacgaatctgctttga

SEQ ID NO: 170 - protein, 560 aa, Leptospira borgpetersenii
MSDILKKRSSMTTDGDNRAPNRAMLRAVGFTDEDFHKPMIGIASTWSEVTPCNIHINKLAEKVKEGVRTAGGVPQIYGTITVSDGITMGHEGMHFSLPSREVIADSIEIVSNAMRHDGVIAIGGCDKNMPGCLMALCRIDAPSIFVYGGTILPGHCDGQDVDIVSIFEAVGKFNAGKISREEFIRIEQNACPGAGSCGGMYTANTMSSAIEALGMSLPGSASMPAVSSRKSEDCYEAGKALINLIQKGVTPKRILTKKAFENAITVVLVLGGSTNAVLHLIAIAKEIGVDLTLEDFDRISKKTPHLADLKPGGRYAMTDLDKVGGVHGVMKYLLKEGMLHGDCLTVTGKTIAENLMDMPDLVPNQTIVRKKSEALHPSGPLVILKGNLAPEGAVAKISGLKKISITGPAKVFESEDDCFNAIMTDQIKPGDVIIIRYEGPKGGPGMREMLAVTSALVGKGLGEDVGLMTDGRFSGGTHGLVVGHISPEAFDGGPIAIVQNGDAVTIDSGKNLLQVEISQEEIQKRLKNWKPIEPRYKSGVLAKYAKLVQSATNGAITNLL

SEQ ID NO: 171 - DNA, 1665 bp, Candidatus Vesicomyosocius okutanii
atgtgcatcccaagaaaatattcctcacaagttgttgatggatttgaacgcgcaccaagtcgtgctatgctttaccccattggttttaaaaaagatgattttagcaaaccccaggttggtatagcaagcacttggtcaatggtaacaccatgtaatatgcatattaataaattagctgataaagccgaaaaagggataaataacgcaggtggtaaaggtgttatctttaacaccattaccatatcagatggtatttctatgggctctgaaggtatgaaatattccttagtatcacgcgaagtcattgccgattcaattgaaacagttgttggttgtcaagggtttgatggtgtggttgctattggtgggtgtgataaaaatatgcctggttgtattattggcttagcacgtcttaatcgccctagtatttttgtttatggcggtactattcaaccgggtaaaaatcgtacagatgtggtaagtgttttcgaagcagttggccgattttctaaccatgaaattgatgaaatagaactagaaaatattgaaaaaacagccgttactggagcaggttcttgtggtggtatgtacactgctaatactatggcatcagcaattgaagcattaggtatgagtttacccaactccagcgcacaaaatgctatatcagatgataaaaataatgattgtatccaagctggagaagctattcttactttattaaataaagacattaaaccccgtgatataatgactatgaaagcattcgaaaatgccatcactgtaattattgcattgggtggctcaaccaatgctgtattgcatttaattgccatggcaaatgccgctgaggttaatctcaaaattgatgattttactcgcattggtaaaaaagtacctgttattgctgaccttaaaccatcaggtaaatatatgatgagtgaattggttgaaattgggggtacattaccactaatgaaaatgctacttgatgcaggactattacatggggattgcatgacagtaacaggaaaaactttagctaaaaatttaaaaaatgttcaatcatatgctgattcccaagaaattattagagcattagataacccaataaagaaagattcacaccttagaattttgcgtggtaaccttgcaattaatggtgctgtggcaaagattactggtaaagaaggttcaagtttcaaaggtacagctaaatgtttttctcatgaagaaggagcgcttaaggctattttaaatgaccaaataaaagcaggtaatgttatcgttattcgttacgaggggcctgttggtggtcctggtatgcgtgaaatgcttgctcctacttctgcagttatggggaaaggattgggtggtaaaattgcacttattactgatgggcgcttctctggtggtacacatggttttgtagtcgggcatatcactcctgaagcctttaaaggtggagtgctagcagtggttgaagatggtgatgaaattataattgatgcacaaaataacgttttagaactattagttgatcaagctattattgataaacgcttatctaaatggacgcaacctaaaccaaactacactaaaggtgtattagcaaaatttgcaaaactagctaaatctgcttctgaaggtgcagttactgattaa

SEQ ID NO: 172 - protein, 554 aa, Candidatus Vesicomyosocius okutanii
MCIPRKYSSQVVDGFERAPSRAMLYPIGFKKDDFSKPQVGIASTWSMVTPCNMHINKLADKAEKGINNAGGKGVIFNTITISDGISMGSEGMKYSLVSREVIADSIETVVGCQGFDGVVAIGGCDKNMPGCIIGLARLNRPSIFVYGGTIQPGKNRTDVVSVFEAVGRFSNHEIDEIELENIEKTAVTGAGSCGGMYTANTMASAIEALGMSLPNSSAQNAISDDKNNDCIQAGEAILTLLNKDIKPRDIMTMKAFENAITVIIALGGSTNAVLHLIAMANAAEVNLKIDDFTRIGKKVPVIADLKPSGKYMMSELVEIGGTLPLMKMLLDAGLLHGDCMTVTGKTLAKNLKNVQSYADSQEIIRALDNPIKKDSHLRILRGNLAINGAVAKITGKEGSSFKGTAKCFSHEEGALKAILNDQIKAGNVIVIRYEGPVGGPGMREMLAPTSAVMGKGLGGKIALITDGRFSGGTHGFVVGHITPEAFKGGVLAVVEDGDEIIIDAQNNVLELLVDQAIIDKRLSKWTQPKPNYTKGVLAKFAKLAKSASEGAVTD

SEQ ID NO: 173 - DNA, 1680 bp, Candidatus Ruthia magnifica
atgcgaagaaaaattatgtacaacccaagaaaatactcctcacaagttgttgacggatttgaacgcgcgccaagtcgtgccatgctttatccagttggatttacaaaagaggattttaacaagcctcaagtcggcatagcaagcacttggtcaatggtaacaccgtgtaatatgcacattaataaattggctgatgagacattaaaaggggtaaatgccacaggtggtaaagccattatttttaacactattactatttcagatggtatttctatgggctctgaaggcatgaagtactctttagtctcacgtgaagttattgccgattcaattgaaactgtggttggttgtcaaggttttgatggtgtggttgcaattggtggttgcgataaaaacatgcctggttgtattattggtttggtacgtcttaatcgccctagtatttttgtttatggaggcacaatccagccgggtaaaaatcatacagatgtggtgagtgtttttgaagcagttggccaatttgccaatcatacaattgatgcgattgaattagaaaatattgaaaaaatagctatccctggtccaggctcttgtggcggtatgtatacggctaacactatggcatcagcgattgaagcattaggtatgagcctgccaaattctagtgcgcaagatgctatttcagatgataaaaataacgactgtgttcaagctggacaggccgtccttaatttattaaacaaagacattaaacctcgtgacattatgaccatgaaggcatttgaaaatgctattaccgtaattattgcattgggtggctcaactaatgctgtattgcatttaattgccatggcaagtgctgctgaggttaatcttaaaattgatgactttactcgcattggccaaaaagtacccgttattgctgaccttaaaccatcaggcaaatacatgatgagtgaattggttaaaattggcggtacattgccgctaatgaaaatgttacttgatgcaggattattgcacggagactgcctaacagtaacaggaaaaactctagctgaaaatttagaaaatgttaagccatacgctgattctcaagaaatcattagagcactagacaacccaataaaaaaagattcacaccttagaattttacgtggcaatcttgcaaccgatggtgctgttgcaaaaattactggcaaagaaggtttgagtttcaaaggcaatgcgaaatgtttttctcgtgaagaggatgcgcttgaagccattttaaataatcaaataataacaggtgatgtgattgttattcgctatgaaggccctgtcggaggtcctggtatgcgcgaaatgctcgcccctacttctgcagttatgggcaaaggcttaggtgataaagttgcgttaattaccgatggtcgtttttctggcggtacacatggttttgtagtcggtcacatcacccctgaagcctttgaaggtggtgtactggctgtggttaaagatggagatgaaatcttaattgatgcacaaaacaacgttttagagttattagttgagcaagcaattatcgataaacgtctatataattggacacaacccaaaccaaactacaccaaaggtgtattggctaaatttgcaaagttggctaaatctgcctctgaaggtgcagtgactgattag

SEQ ID NO: 174 - protein, 559 aa, Candidatus Ruthia magnifica
MRRKIMYNPRKYSSQVVDGFERAPSRAMLYPVGFTKEDFNKPQVGIASTWSMVTPCNMHINKLADETLKGVNATGGKAIIFNTITISDGISMGSEGMKYSLVSREVIADSIETVVGCQGFDGVVAIGGCDKNMPGCIIGLVRLNRPSIFVYGGTIQPGKNHTDVVSVFEAVGQFANHTIDAIELENIEKIAIPGPGSCGGMYTANTMASAIEALGMSLPNSSAQDAISDDKNNDCVQAGQAVLNLLNKDIKPRDIMTMKAFENAITVIIALGGSTNAVLHLIAMASAAEVNLKIDDFTRIGQKVPVIADLKPSGKYMMSELVKIGGTLPLMKMLLDAGLLHGDCLTVTGKTLAENLENVKPYADSQEIIRALDNPIKKDSHLRILRGNLATDGAVAKITGKEGLSFKGNAKCFSREEDALEAILNNQIITGDVIVIRYEGPVGGPGMREMLAPTSAVMGKGLGDKVALITDGRFSGGTHGFVVGHITPEAFEGGVLAVVKDGDEILIDAQNNVLELLVEQAIIDKRLYNWTQPKPNYTKGVLAKFAKLAKSASEGAVTD

SEQ ID NO: 175 - DNA, 1689 bp, Methylococcus capsulatus
atgaccgacaagcacccccgtccccattcgtcccaggtcgtcgacggcatggagcgcgccccgagccgcgcgatgctgcacgccgtcggcttcgccgatgccgacttcgccaaaccgcagatcggcatcgcttccacctgggcgatggtgacgccgtgcaacatgcacatcaacaagctcgccgaggacgcagcacgcggcgtcgacggcggcggcggcaaggcagtgatcttcaacaccatcaccatttccgacggcatctcgatgggcaccgaaggaatgaaatactccctcgtgtcgcgggaagtcatcgccgactcgatcgaaaccgtggtggcctgtcagggttatgacggcgtggtcgccatcggcggctgcgacaagaacatgcccggctgcctgatcgccctcgcccgcctcaaccgtccggcggtgttcgtctatggcggcaccatcctgccgggctgccacgacggcaagaagctggacgtggtgtcggtgttcgaagcggtcggcgcccgcgccaaccaccgcatcgacgatgccgaactgcacgccatcgaatccaatgccatccccggtccgggctcctgcggtggcatgtataccgccaacaccatggcctccgccatcgaggcattagggatgagcctgccgggcagttcggcccaggtggccatttcccgcgccaaggaactggattgcgagcgggccggcgcgcaggtcctcaagctcctggacctggggctcaaaccccgcgacatcatgaccaagaaggcgttcgagaacgccatcacggtggtgatcgccctgggcggctccaccaacgccgtgctgcacctcctggccatggccaacgcctgcggcgtcgacctgaagctcgacgatttcacccgcatcgggcgcaaagtgccgatgctggcggatctgaaacccagcggcagatactccatggccgaactggtggaaatcggcggcatccagccgctgatgaagaccttgctggacgcgggactcctgcacggcgactgcatgaccgtaaccggcaagaccctggaagaaaacctggccgacgcgcccgactacccggccggacaagacatgatccggtcgctggacaaccccatcaaaaaggacagccatctggtgatcctcaagggcaacctggcgccggaaggcgcggtcgccaagatcaccggcaaggaaggactgagcttcaccggcaccgcccgcgtattcgactgcgaggaagcggcgctcacggccatcctcgacggcacgatcgtgaaaggcgacgtcatcgtcatccgctatgaaggccccaagggcggccccggcatgcgcgagatgctctcgccgacctcggcggtcatgggcaagggattgggcaaggaggtcgccctcatcaccgacggccgcttttccggcggcacccacggcttcgtggtcggccacatcacgccggaagcctacaccggcggccccctggcgatcgtccgggacggcgataccatcaccatcgacgccgagacccgcgaattgagcctgcacgtcaccgacgatgaaatcggccggcgcctggcgcagtggactcaaccggcgccgcgctacaccaagggcgtgctggccaaatacgccaggttggtgagcccggcctcggaaggcgccgtcaccgacgacggcctctga

SEQ ID NO: 176 - protein, 562 aa, Methylococcus capsulatus
MTDKHPRPHSSQVVDGMERAPSRAMLHAVGFADADFAKPQIGIASTWAMVTPCNMHINKLAEDAARGVDGGGGKAVIFNTITISDGISMGTEGMKYSLVSREVIADSIETVVACQGYDGVVAIGGCDKNMPGCLIALARLNRPAVFVYGGTILPGCHDGKKLDVVSVFEAVGARANHRIDDAELHAIESNAIPGPGSCGGMYTANTMASAIEALGMSLPGSSAQVAISRAKELDCERAGAQVLKLLDLGLKPRDIMTKKAFENAITVVIALGGSTNAVLHLLAMANACGVDLKLDDFTRIGRKVPMLADLKPSGRYSMAELVEIGGIQPLMKTLLDAGLLHGDCMTVTGKTLEENLADAPDYPAGQDMIRSLDNPIKKDSHLVILKGNLAPEGAVAKITGKEGLSFTGTARVFDCEEAALTAILDGTIVKGDVIVIRYEGPKGGPGMREMLSPTSAVMGKGLGKEVALITDGRFSGGTHGFVVGHITPEAYTGGPLAIVRDGDTITIDAETRELSLHVTDDEIGRRLAQWTQPAPRYTKGVLAKYARLVSPASEGAVTDDGL

SEQ ID NO: 177 - DNA, 1662 bp, unknown
  uncultured marine bacterium EB80_02D08
atgacaaatagaaaatattcaaaagaacttttagatggaccaaatcaagcagcatcaagatcaatgcttagaggagtaggatttacatctgatgatttcaagaagccacttgtaggaattgcatcaactggggcaaaagttactccatgcaatatgcatattaatcagctgtcagaaattgttgagcattcagttgataattccggaggtaaaggagtgctattcaatactattacagtttctgatggtatatcaatgggaacacaaggcatgaaatactcactcgtttcaagagaagtcatagcagattctatagaaactgttgtgggctgtcttggttatgatggtgttatagcagttggtggatgtgataaaaatatgcccggatgtattatcggcatggcaaggcttaatagaccttccatatttatatatggtggctcaatcagacccagtgaagaaaataccgattatgtaactgtatgtgaaaagactggtgagttttctaaaggcgatctagacgaatctcaactaattcatgtagaaaaaatatctgtaaagggtcctggatcctgtggaggtatgtatacagccaatactatggcatctgctattgaggcattgggtatgagtcttcctggaagtagcagtcaagatgctgtctcaaatgataaagaagatgattgcataaaagctggtatagcgatcatgggcttattagaaaaagacatcaagccttcagacattatgacaaaaaaagcttttgagaattctataactatggtgattgctttaggcggttccacaaatgcagtacttcatttacttgctatggctgatgcaattggagttgatttaacgcttgatgactttacaagaatcggtaaaaagacgccagtcttagcagatttaaagccttttggctctcattatatgtctgagcttaatgcaaatggagggatacagccgctaatgaaaacccttttagataaaggcttacttcatggtgattgtcttactgttacagggaaaacactctcagaaaatctttctttagttaaaccttatgaattacatcaagatattatcaaggagtttgatagtccaataaaagctaatagtcatctcaggatactatatggaaatttagctgaagaaggagcggttgcaaaaataacaggaaaagagggaacttcttttgaaggtagcgctcgagtttttaattcagaggaagaaggcgttgaggctattttatcaaaatcaattaaacctggcgacgttgtagtaataagatatgagggaccaaaaggtggtcctgggatgagagaaatgttgaagcctacttcggcaatcatgggccaaggcctgggagataaagttgcatttattaccgatggtcgtttttcaggaggtactcatggttttgttgttggacacattacaccagaagcggcagatggtgggctaatagcaattattgaagatggtgattcaatactaattgatgcaaactcggataaactagtactgaatatctctgatgatgagatttcaactagacttagtaaatgggttaaccctaaaacgcctccaagaaaaggtgttctagcaaaatttgcacgaaatgttaaatcagcaagtcttggagcggtgacagattaa

SEQ ID NO: 178 - protein, 553 aa, unknown
  uncultured marine bacterium EB80_02D08
MTNRKYSKELLDGPNQAASRSMLRGVGFTSDDFKKPLVGIASTGAKVTPCNMHINQLSEIVEHSVDNSGGKGVLFNTITVSDGISMGTQGMKYSLVSREVIADSIETVVGCLGYDGVIAVGGCDKNMPGCIIGMARLNRPSIFIYGGSIRPSEENTDYVTVCEKTGEFSKGDLDESQLIHVEKISVKGPGSCGGMYTANTMASAIEALGMSLPGSSSQDAVSNDKEDDCIKAGIAIMGLLEKDIKPSDIMTKKAFENSITMVIALGGSTNAVLHLLAMADAIGVDLTLDDFTRIGKKTPVLADLKPFGSHYMSELNANGGIQPLMKTLLDKGLLHGDCLTVTGKTLSENLSLVKPYELHQDIIKEFDSPIKANSHLRILYGNLAEEGAVAKITGKEGTSFEGSARVFNSEEEGVEAILSKSIKPGDVVVIRYEGPKGGPGMREMLKPTSAIMGQGLGDKVAFITDGRFSGGTHGFVVGHITPEAADGGLIAIIEDGDSILIDANSDKLVLNISDDEISTRLSKWVNPKTPPRKGVLAKFARNVKSASLGAVTD

SEQ ID NO: 179 - DNA, 1599 bp, unknown
  uncultured marine gamma proteobacterium EBAC31A08
atgcttagaggagtaggtttcacatctgaggmtttcacaaaaccatttgttgggattgcttccacaggagcaaaagtaaccccatgcaatatgcacataaatgcactttcagagatcgttgagaaatcagttgatagttcaggaggaaagggtgttctttttaatactattactgtttccgatggaatttctatgggtacacagggtatgaaatattctcttgtttctcgagaggtaattgcagattcaatagaaactgttgtgggatgtcttggttatgatggagttattgctgtcggtggttgtgataaaaatatgcctggatgcattattggaatggcaagattaaatagaccatcaatatttatatatggtggttctatcaaacctagtaaagaaaataccgactatgttactgtttgtgagaaaactggagagtactcaaaaggcgatcttaaagaatctgaattaattcatgtagaaaaaatttccgtaaaagggcctggatcttgtgggggaatgtatacggcaaatactatggcttctgcgattgaagctctaggcatgagtcttcctggaagcagcagtcaagatgcaatttcacacgacaaagaagatgattgttttaaggctggcgaagcgataatgaatttattagaaaaagatattaagccttcagatattatgactaagaatgcttttgagaatgctataacaatggtaattgctctaggaggttcaactaatgcagttctgcatttattggccatggcgcattcaataggggttgatttagagctagatgactttacaagaataggaaaaaaaacacccgttatggcagatcttaagccctttggttctcattatatgtctgaactcaatgctaatggcggtattcagccactaatgaaaactttgcttgagaagggattactacacggcaattgtcttaccgttaccggtcagacgcttgctgaaaatctttctggaataaaaccttacgagcctgatcaagagataattaaatcatttgataatccaattaaatcaaatagccatcttagaattctgtatggcaacttagcgaaagatggtgcagttgcaaaaattacgggtaaagaaggaacttcctttgaaggaagtgctcgtgtatttgattcagaagaagaaggggttaaagcaatcctatctaaatctataaaagctggagatgttgttgtaattagatatgaagggccaaaaggaggtccaggcatgagagaaatgctaaaaccaacatctgccataatgggtcaaggtcttggcgatcaggtagcttttataacagacggtcgtttttcaggaggcactcatggatttgttgttgggcacattactccagaggctgcagatggcggcttaattgcaataattaaagatggcgactctatattaattgatgcagattctgataagttaattcttaatatttctgaggatgaaatttcaaatagactaagtagatgggtaaacccaaaaacgcctcccaaaaaaggagtcttagcaaaatttgcaaaaagtgttaaatcagctagtcttggagcggtaacagattaa

SEQ ID NO: 180 - protein, 532 aa, unknown
  uncultured marine gamma proteobacterium EBAC31A08
  misc_feature (11)..(11): Xaa can be any naturally occurring amino acid
MLRGVGFTSEXFTKPFVGIASTGAKVTPCNMHINALSEIVEKSVDSSGGKGVLFNTITVSDGISMGTQGMKYSLVSREVIADSIETVVGCLGYDGVIAVGGCDKNMPGCIIGMARLNRPSIFIYGGSIKPSKENTDYVTVCEKTGEYSKGDLKESELIHVEKISVKGPGSCGGMYTANTMASAIEALGMSLPGSSSQDAISHDKEDDCFKAGEAIMNLLEKDIKPSDIMTKNAFENAITMVIALGGSTNAVLHLLAMAHSIGVDLELDDFTRIGKKTPVMADLKPFGSHYMSELNANGGIQPLMKTLLEKGLLHGNCLTVTGQTLAENLSGIKPYEPDQEIIKSFDNPIKSNSHLRILYGNLAKDGAVAKITGKEGTSFEGSARVFDSEEEGVKAILSKSIKAGDVVVIRYEGPKGGPGMREMLKPTSAIMGQGLGDQVAFITDGRFSGGTHGFVVGHITPEAADGGLIAIIKDGDSILIDADSDKLILNISEDEISNRLSRWVNPKTPPKKGVLAKFAKSVKSASLGAVTD

SEQ ID NO: 181 - DNA, 1659 bp, unknown
  uncultured marine gamma proteobacterium EBAC20E09
atgagctctagaaaatattcaaaagaccttgttgatggcccaaatcaagctgcatcaagatcaatgctgcgtggggttggatttactactgaagatttttcaaaatcttttgtaggcattgcatcaacaggtgcaaaagttacaccgtgtaatatgcatatcaataaacttgcagaagttgttgagaattcggtgaatgtatctggaggtaaaggagtactttttaatactattactgtatcagacggcatatcaatgggaactcaaggcatgaaatattctcttgtatcaagagaggttatagctgattcaattgaaacagttgttggttgtttaggttatgatggcttaatcacaattggtggctgtgataagaacatgcctggctgtttgataggcatggcaagattgaaccgaccatccattttcatttatggggggtcaattaagccaagtaatgaaaaaaccgactatgtcacagtatcagaaaaggttggtgaattctccaaaggcgacattgatgaaaaagaactcattcattatgaaaaaatttcagtagaaggcccaggatcatgcggtggtatgtataccgcaaatacaatggcttcagctatcgaagctttaggaatgagtttaccaggcagcagcagtcaagatgcagtttcaaaatctaaaaatgaagattgcatttctgcaggaatagccataatgaatttgcttgaaaaagatttaaaaccctctgacattatgacaaaggaggcttttgaaaatgcaattacagttgttattgcattaggtggatcgacaaatgctgttcttcatttattagctatggctcatgccgtaggtgtcgaacttcaattggatgattttacaaaaattggaaaactcactccggtacttgcagacctcaaaccatttggtaatcattttatgtctgagttaaatgcaaacggtggaatacagccactaatgaaaagtttattagataaaggaatgctgcatggaaattgtttgacggttactggtaattcattagaagaaaatttaaaagatatagagccgtataaagatgaaaaaataataaaaagcttagataatccaattaaatctgatagtcatttaagagtgttatatgggaacttagctaaggatggcgctgttgcaaaaattacaggaaaggagggcttttcatttgaaggcaaagccaaagtatttaactcggaagaagatggagttcaggcaatccttgcaaaaaaaattgttccaggtgatgtagttgtaattagatatgagggaccaaaaggtggtccgggcatgagagaaatgttaaagccaacatctgcgatcatggggttaggcttaggagataaagttgcttttataactgacggtagattttctggaggaactcatggatttgttgtgggccatgtatctccagaggcagcagatggaggcctaattgctttaatcaaagatggagacaatatcttgatagatgcagaaaatgatgaattaatactaaaggttgatcaagacgaaattgatttaagaaagaagaactggaaaaatcctactaatcctcctaaaaaaggagttcttgcaaagtatgctgcaagtgtaaaatctgccagcttaggagcaattactgattaa

SEQ ID NO: 182 - protein, 552 aa, unknown
  uncultured marine gamma proteobacterium EBAC20E09
MSSRKYSKDLVDGPNQAASRSMLRGVGFTTEDFSKSFVGIASTGAKVTPCNMHINKLAEVVENSVNVSGGKGVLFNTITVSDGISMGTQGMKYSLVSREVIADSIETVVGCLGYDGLITIGGCDKNMPGCLIGMARLNRPSIFIYGGSIKPSNEKTDYVTVSEKVGEFSKGDIDEKELIHYEKISVEGPGSCGGMYTANTMASAIEALGMSLPGSSSQDAVSKSKNEDCISAGIAIMNLLEKDLKPSDIMTKEAFENAITVVIALGGSTNAVLHLLAMAHAVGVELQLDDFTKIGKLTPVLADLKPFGNHFMSELNANGGIQPLMKSLLDKGMLHGNCLTVTGNSLEENLKDIEPYKDEKIIKSLDNPIKSDSHLRVLYGNLAKDGAVAKITGKEGFSFEGKAKVFNSEEDGVQAILAKKIVPGDVVVIRYEGPKGGPGMREMLKPTSAIMGLGLGDKVAFITDGRFSGGTHGFVVGHVSPEAADGGLIALIKDGDNILIDAENDELILKVDQDEIDLRKKNWKNPTNPPKKGVLAKYAASVKSASLGAITD

SEQ ID NO: 183 - DNA, 1659 bp, unknown
  uncultured gamma proteobacterium eBACHOT4E07
atgagctctagaaaatattcaaaggaattagttgatggtccaaatcaggccgcatctcgttctatgcttcgaggtgtaggatttacatctgaggactttacaaagccatttgttggaattgcatcaactggagccaaagttacaccatgtaatatgcatatcaatcaattatcagaattggtagaagactcaataaatgcatctggtggcaaaggtgttttatttaatacaattactgtttctgatggcatttcaatgggaacgcaaggaatgaaatattctcttgtttcaagagaagttattgctgactcaattgaaactgttgtaggttgccttggatatgatggattaattgcaattggtggatgtgataagaacatgcctggatgtcttattggtatggcaagattaaatagaccgtcaatatttatttatggtggatctataaaaccaagtaatgagaatacggactatgtcactgtctcagaaaaagttggagaattctcaaagggctctataaatgaagatgagctaattcattatgaaaagatatcagttgatggaccaggctcatgtggcggaatgtatacagcaaatacaatggcatctgccatagaggcattaggaatgagtttgccaggtagcagtagccaagatgcaacatctaaatcaaagaacgctgattgtgtgaatgctggatcggcaatcatgaatttactagataaagatattaaaccttctgacattatgacaagagaagcatttgaaaatgctataactgttgtaatagctctaggaggatcaacaaatgccgttcttcatttattggccatggctcattcaattggagttgaactttgcttagatgactttacttcaattggaaagaaaacacctgtattagcggacctaaaaccctttggaaaacactatatgtctgagcttaatgcaaatggaggaattcagcccttaatgaaaactcttttagacaaaggacttcttcatggtcaatgtatgacagttacaggcaataccttagaagaaaatttaaaagacataaaagcatatgagacgagtgaaataattaaagattttaataatccaatcaaaaaagatagtcatcttagaattttatacggcaaccttgctaaagatggcgcggttgcaaaaattacaggtaaagaaggaacatcttttgaaggaaaagcaaaagtatttaattcagaagaagagggcgtaagtgcgattctatcaaatcagattaatgatggtgatgtaatcgtaataaggtatgagggtccaaagggtgggcctggcatgagagaaatgctaaaacctacttctgcaatcatgggattaggactaggagataaaataggatttattacagatggaagattttcaggtggcacccatggttttgtagttggacatgtttctccagaagcagctgagggtggtttaatagcattagttgaagatggagatactatacttattgatgcagaaagtgatcagcttgttctaaaagttgatgatgatgaaattaaaagaagacaatcaatttggaaaaatccaaacagtaaaccaaaaaaaggagtacttgctaagtatgctgagagcgtaaaatctgcaagcctgggagctataactgattaa

SEQ ID NO: 184 - protein, 552 aa, unknown
  uncultured gamma proteobacterium eBACHOT4E07
MSSRKYSKELVDGPNQAASRSMLRGVGFTSEDFTKPFVGIASTGAKVTPCNMHINQLSELVEDSINASGGKGVLFNTITVSDGISMGTQGMKYSLVSREVIADSIETVVGCLGYDGLIAIGGCDKNMPGCLIGMARLNRPSIFIYGGSIKPSNENTDYVTVSEKVGEFSKGSINEDELIHYEKISVDGPGSCGGMYTANTMASAIEALGMSLPGSSSQDATSKSKNADCVNAGSAIMNLLDKDIKPSDIMTREAFENAITVVIALGGSTNAVLHLLAMAHSIGVELCLDDFTSIGKKTPVLADLKPFGKHYMSELNANGGIQPLMKTLLDKGLLHGQCMTVTGNTLEENLKDIKAYETSEIIKDFNNPIKKDSHLRILYGNLAKDGAVAKITGKEGTSFEGKAKVFNSEEEGVSAILSNQINDGDVIVIRYEGPKGGPGMREMLKPTSAIMGLGLGDKIGFITDGRFSGGTHGFVVGHVSPEAAEGGLIALVEDGDTILIDAESDQLVLKVDDDEIKRRQSIWKNPNSKPKKGVLAKYAESVKSASLGAITD

SEQ ID NO: 185 - DNA, 1686 bp, Alcanivorax borkumensis
atgagtgactcaaagggcgatccgcgtcgccgccattcagcaaaggtcgtggacggccccggtaaatccgccagccgggccatgctgcgggcggtggggtttaccgatgaggattttcataaaccccaggtgggcattgcttctacttggagtcaggtgacgccgtgcaatagccatatcggtgagctcgccgaaaaagcctgcgctggagccgatgcggccggcggcaaaggggtaattttcaataccatcaccatctccgatggcatcgccaatggtaccgaagggatgaagtattcgttggtctcccgcgaggtgattgccgattccattgaaaccgtggcggcttgtgaaggctttgacggcctggtagctcttggtggctgcgataagaacatgcccggttgcctaatgggcatggcgcggctgaatcgccccagcgtctttgtctacggcggcaccatcatgcccggcaagggccacacggatattgtttctgtgttcgaagccatgggagcccattcccgcggcgacatggacaaaatcgaactcaagcagatagaagaaactgccattcccgggcccggtgcttgcggcggcatgtacacggccaacactatggcctcggctattgaagcgctgggcatgagcctgccgggcagctccgcacagaatgcggtgtcggaagagaagcgtgatgattgccagcgcgccggcgaagcagtgttggcgctactggaacaggacatcaagccctcggacatcatgacgcgggctgcatttgagaacgccatcactgtggtgatcgccctgggcggttccaccaatgcggtgctgcacctgatcgccatggcgcgcaccgtgggggtgccgctgtcgctggatgactttaccgagatcggcaggcgggtgccggtgctggcggacctgcgccccagtggccattacatgatgagcgagttggtggccatcggcggtattcagccgttgatgaaggtgctgttggaggcgggtttgctgcagggtgattgcctgacggtcaccggccgtaccttggctgagaacctggcggatgtcagtccttatccactggatcagacgatcatcgcgccactgtctgcgccgctgaaagcagaaagtcacctgcgcatcctttatggcaatttggcgccggatggcgcagtggccaagatcaccggcaaggaaggcacccacttttccggcccggcccgggtgttcggttcggaagaagaagcgcagcagcggatcaatgatgggactgtggtgtccggggacgtggtggtgatccgctatgaaggcccccgcggcggcccaggcatgcgtgaaatgctcacccccacctctgccatcatggggcgcggcctgggtgacgaggtggcgctgattaccgatggtcgcttttccggcggcagccatggtttcgtggtaggccacgtgaccccagaagctttcgatggtggtccgctggcattattggaaaacggtgaccaaattaccattgatgccgaagccaacaccctggtcgtggcgctgtctgatgcggagttggcgcgccgccgtgctaactggcaacagccagcaccacgctatacccgtggtgtgctggccaaatacgcacggctggtgggttcggccagcgaaggcgcgctgacggacttaggttaa

SEQ ID NO: 186 - protein, 561 aa, Alcanivorax borkumensis
MSDSKGDPRRRHSAKVVDGPGKSASRAMLRAVGFTDEDFHKPQVGIASTWSQVTPCNSHIGELAEKACAGADAAGGKGVIFNTITISDGIANGTEGMKYSLVSREVIADSIETVAACEGFDGLVALGGCDKNMPGCLMGMARLNRPSVFVYGGTIMPGKGHTDIVSVFEAMGAHSRGDMDKIELKQIEETAIPGPGACGGMYTANTMASAIEALGMSLPGSSAQNAVSEEKRDDCQRAGEAVLALLEQDIKPSDIMTRAAFENAITVVIALGGSTNAVLHLIAMARTVGVPLSLDDFTEIGRRVPVLADLRPSGHYMMSELVAIGGIQPLMKVLLEAGLLQGDCLTVTGRTLAENLADVSPYPLDQTIIAPLSAPLKAESHLRILYGNLAPDGAVAKITGKEGTHFSGPARVFGSEEEAQQRINDGTVVSGDVVVIRYEGPRGGPGMREMLTPTSAIMGRGLGDEVALITDGRFSGGSHGFVVGHVTPEAFDGGPLALLENGDQITIDAEANTLVVALSDAELARRRANWQQPAPRYTRGVLAKYARLVGSASEGALTDLG

SEQ ID NO: 187 - DNA, 1713 bp, Chromohalobacter salexigens
atgagccagcaggactcccccgccaacgccgatcaccgtcgccgccattcctccatcgtggtcgacggccccggcaaggccgccagtcgcgccatgctgcgtgccgtcggtttcaccgacgaggatttcaagaagccgcaggtggggatcgcctcgacctggagtcgcgtcacgccgtgcaacagccacatcaacgtgttggccgatgccgccagtgacggcgccgacgccgccggtggcaagggcgtggtcttcaataccatcaccatcagcgacggcatcgccaacggcaccgaaggcatgaagtattcgatggcctcgcgcgagatcatcgccgattccatcgaggcggtctccggctgcgaggggttcgacggggtggtggccatcggtggctgcgacaagaacatgcccggctgcatgatcggcctggcacgtctcaaccggcccagcatcttcgtctacggcggtaccatccagcccggtgccgggcacaccgacctggtctcggtattcgaggcgatgggcgcctactcccagggcaacaagtcgctgatcgaggtcaagcagatcgaggaagtcgcgattcccgggccgggctcctgtggcggcatgtacaccgccaacaccatggcctcggcgatcgaggccatgggcatgagcctgcccaattcgtcggctcaggacgcggtatcccagagcaagaaggacgatagtcgcgccgccggcgaggccgtgctcaagctgctcgaactggacatcaagccctcggacatcatgacccgcaaggcgttcgagaacgccatcaccgtggtcatcgccctcggcggttccaccaatgccgtgctgcacctgattgccatggccaacaccatcggggtcgagctctcgctcgacgactttaccgagatcggcaagcgcgtcccggtgctcgccgacctgcgccccagcggtcattatctgatgagcgagctggtggcgatcggcggcattcagccgatgatgaagattctgctcgatgcggggctgctccacggcgattgcctgaccgtgaccggcaagacgctggccgagaacctggccgacgtgacgccttatccgacggggcaggaaatcatcaagccgctggaggcaccgatcaaatcgagcagccacctgcgcattctctacggcaacctggcgccagagggagcggtggccaagatcaccggcaaggaaggtacccgcttcaccgggcgtgctcgcgtgttcaactccgaggaggaggcccaggcgcgcatcaacgacctgaccgtggccgccggtgacgtcgtcgtgattcgctacgaggggccgaagggcggtcccggcatgcgcgaaatgctgacgccgacctcggcgatcatgggccgtggcctgggcgacaaggtggccttgatcaccgatggacgcttctccggcggcagccatggcttcgtggtcggtcacatcacgccggaagccttcgtcggcggccccatcggcctggtcgaggacggtgacgagatcaccatcgacgccgagaacgacatcatgacgctgcatatcgacgacgccgagatggcgcgccgccgtgcggcctggaagcgcccggcaccgcgttatacgcgcggcacgctggccaagtacgccaagacggtcagctcggcatcgaaaggggcggtcaccgatctgcccgaagcgctggacgattga

SEQ ID NO: 188 - protein, 570 aa, Chromohalobacter salexigens
MSQQDSPANADHRRRHSSIVVDGPGKAASRAMLRAVGFTDEDFKKPQVGIASTWSRVTPCNSHINVLADAASDGADAAGGKGVVFNTITISDGIANGTEGMKYSMASREIIADSIEAVSGCEGFDGVVAIGGCDKNMPGCMIGLARLNRPSIFVYGGTIQPGAGHTDLVSVFEAMGAYSQGNKSLIEVKQIEEVAIPGPGSCGGMYTANTMASAIEAMGMSLPNSSAQDAVSQSKKDDSRAAGEAVLKLLELDIKPSDIMTRKAFENAITVVIALGGSTNAVLHLIAMANTIGVELSLDDFTEIGKRVPVLADLRPSGHYLMSELVAIGGIQPMMKILLDAGLLHGDCLTVTGKTLAENLADVTPYPTGQEIIKPLEAPIKSSSHLRILYGNLAPEGAVAKITGKEGTRFTGRARVFNSEEEAQARINDLTVAAGDVVVIRYEGPKGGPGMREMLTPTSAIMGRGLGDKVALITDGRFSGGSHGFVVGHITPEAFVGGPIGLVEDGDEITIDAENDIMTLHIDDAEMARRRAAWKRPAPRYTRGTLAKYAKTVSSASKGAVTDLPEALDD

SEQ ID NO: 189 - DNA, 1677 bp, Marinobacter algicola
atgacagaagacaaacgccgccgttattccgcgcccgtggtcgatggcctgggcaagtcggcaagccgcgccatgttgcgggccgtggggtttaccgatgaagatttccgcaaaccccagatcggtattgcctcgacctggagcaacctgacgccctgcaatatgcacatcaaccaactggcggaggaatcggccgcgggtgccgacgaggccgggggcaagagcctgacgttcaataccatcaccgtttccgacggcatcgccaacggcacggagggtatgaagtactccctggtgtcgcgggaagtcattgccgactccattgaaaccgtggctggttgtgaaggttttgatggcctggttgccattggcggctgcgacaagaacatgcccggctgcatgatgggcctggcgcgcctgaaccggccgtcggtatttgtctatggcggcaccatcatgcccggcgagaatcacaccgacatcatctcagtatttgaggcggtgggtgcccatgcccggggtgacctggacctgattgaggtcaaacagatcgaggaaaccgcgattccggggccaggctcctgcggcggcatgtacaccgccaacactatggcctcggcgattgaagccatgggcatgagcctgccgggcagttccgcccagaacgctgtttccgagaccaaggcggccgactgcagggcggcgggcgcggccgtcctcaacctgctggagaaagatctcaagccatcggacatcatgacccgggaggcgttcgagaatgctatcaccgtggtaattgccctgggtggctccaccaacgcggtgctgcacctgattgccatggccagcaccgttggcgttgacttgacgctggacgacttcgtggaaatcggcaaacgggttcccgtattggcagatctgcgccccagcggtcactacatgatgtcggaactggtggcgatcggcggcattcagccgttgatgaagatgctgctcgaccgtggcatgctccatggcaactgcatgaccgtcaccgggcagacactggcggacaacctgaaagacgtggctccgtacccggcaagccaggacatcattcatgcctttgatgaccccatcaaggcggatagccatctgcgtatcctttacggcaacctggcgcctactggtgcggtggccaagatcactggtaaggagggtacccatttcaccggccgtgcacgggtgttccagtccgaggaagaggcccaggagcggatcatggacggcaccgttgtggccggagacgtgttggtgatccggtttgaaggccccaaaggtgggccgggcatgcgggagatgctaacgccgacttctgccatcatgggtaaagggctgggcagcgatgtggcgctgattaccgacgggcgtttttccggtggcagccacggtttcgtggttggtcatattacgccggaggccgcagaaggtgggccgattgcgctggtggaaactggcgacaccatcaccattgatgcagtggccaatcgcattgagctggatgtttcggagcaggaaatggagcgccgccgacaggcatggaccgcaccggctccccgatttacccgcggggtgctggccaaatacgcgcgcaccgtgagttccgcttcggaaggcgcagtgacagacaagccgtga

SEQ ID NO: 190 - protein, 558 aa, Marinobacter algicola
MTEDKRRRYSAPVVDGLGKSASRAMLRAVGFTDEDFRKPQIGIASTWSNLTPCNMHINQLAEESAAGADEAGGKSLTFNTITVSDGIANGTEGMKYSLVSREVIADSIETVAGCEGFDGLVAIGGCDKNMPGCMMGLARLNRPSVFVYGGTIMPGENHTDIISVFEAVGAHARGDLDLIEVKQIEETAIPGPGSCGGMYTANTMASAIEAMGMSLPGSSAQNAVSETKAADCRAAGAAVLNLLEKDLKPSDIMTREAFENAITVVIALGGSTNAVLHLIAMASTVGVDLTLDDFVEIGKRVPVLADLRPSGHYMMSELVAIGGIQPLMKMLLDRGMLHGNCMTVTGQTLADNLKDVAPYPASQDIIHAFDDPIKADSHLRILYGNLAPTGAVAKITGKEGTHFTGRARVFQSEEEAQERIMDGTVVAGDVLVIRFEGPKGGPGMREMLTPTSAIMGKGLGSDVALITDGRFSGGSHGFVVGHITPEAAEGGPIALVETGDTITIDAVANRIELDVSEQEMERRRQAWTAPAPRFTRGVLAKYARTVSSASEGAVTDKP

SEQ ID NO: 191 - DNA, 1677 bp, Marinobacter aquaeolei
atgacaaccgataaacgacgccgacactcggcaccggtggtagacggtatcaataaatccgccagccgggccatgctccgggcggtaggttttaccgacgaggatttccgcaaaccccagattggcattgcctccacctggagcaaccttacgccctgcaacatgcacattgacggcctggcccgggaggccgccaagggtgccgacggagccgggggcaagagcctgatcttcaacaccatcactatctctgatggcatcgccaacggcaccgagggcatgaaatattccctggtgtcgcgcgaggtgattgccgattccattgagaccgtggccggttgtgagggcttcgacggactggtcgccatcggtggctgcgacaagaacatgcccggctgcatgatgggcctggcccggctgaaccggccctcggtcttcgtttacggcggcaccatcatgcccggcgagaaccataccgacatcatctccgtgtttgaggcggtgggcgcccatgcccgcggtaacatggagctgatcgaagtcaaacagatcgaggaaaccgcgattcccgggccaggctcctgtggcggcatgtacaccgccaacaccatggcctccgccattgaggccatgggtatgagcctgccaggcagctcggcccagaacgccatctccgacagcaaactggcggattgcgaagccgcaggcgccgcggtgctgaaactgctcgaagccgatatcaagccctccgacatcatgacccgggaagcgttcgagaacgccatcaccgtggtggtcgcgctgggcggttccaccaacgccgtgctgcaccttctgggtatggccagtaccgtgggagtggagctgtcactggacgatttcgtacgcatcggcaaacaggtaccagtcctggcggaccttcgcccctccggccactacatgatgtccgagctggtggccattggtggcattcaaccgctaatgaagatgctgctcgaccgggggctgctgcatggagactgcctcacggtaaccggcaaaaccctggcagagaatctcgagaccgtggtgccctaccccgaagaccagcagatcatccacgccttcgacaacccgatcaaagccgacagtcatctgcgtattctctatggcaacctggctccggaaggctcggtggcgaaaatcaccggtaaggaaggcacgcatttttccggtcgagcccgagtgtttcactctgaagaggaagcccaggagcgaatcctggatggcaccgtggtcgctggcgacgtgctggtgatccgatacgaaggcccgaagggcgggcctggcatgcgggaaatgctcagccccacctcggcgattatgggcaaaggtcttggcagtgatgtggctctgattacagacggccgcttctccggtggcagtcatggttttgtggttggccatatcacaccagaggccgccgtgggcgggccgattgcgctggtagaagacggcgacaccattaccattgatgccgtgagcaactcgattgtgctggaaatctctgacgaggaaatggaaaaacggcgcaaagcctggacgccgccggaacccagatttacccggggcgtgctggccaaatatgcccgtgtggtgagctctgcatctacgggggccgttaccgacctgccctag

SEQ ID NO: 192 - protein, 558 aa, Marinobacter aquaeolei
MTTDKRRRHSAPVVDGINKSASRAMLRAVGFTDEDFRKPQIGIASTWSNLTPCNMHIDGLAREAAKGADGAGGKSLIFNTITISDGIANGTEGMKYSLVSREVIADSIETVAGCEGFDGLVAIGGCDKNMPGCMMGLARLNRPSVFVYGGTIMPGENHTDIISVFEAVGAHARGNMELIEVKQIEETAIPGPGSCGGMYTANTMASAIEAMGMSLPGSSAQNAISDSKLADCEAAGAAVLKLLEADIKPSDIMTREAFENAITVVVALGGSTNAVLHLLGMASTVGVELSLDDFVRIGKQVPVLADLRPSGHYMMSELVAIGGIQPLMKMLLDRGLLHGDCLTVTGKTLAENLETVVPYPEDQQIIHAFDNPIKADSHLRILYGNLAPEGSVAKITGKEGTHFSGRARVFHSEEEAQERILDGTVVAGDVLVIRYEGPKGGPGMREMLSPTSAIMGKGLGSDVALITDGRFSGGSHGFVVGHITPEAAVGGPIALVEDGDTITIDAVSNSIVLEISDEEMEKRRKAWTPPEPRFTRGVLAKYARVVSSASTGAVTDLP

SEQ ID NO: 193 - DNA, 1692 bp, Marinobacter sp.
atgagtgataccccccaagaccctcgccgccgttattccgctccggttgtggacggtgtggctaaatccgccagtcgttccatgctgagggccgtcggttttaacgacgaagatttcagcaaaccgcagatcggcattgcttccacctggagtatggttaccccctgtaatagccacattaacgagctggccgacattgcttgtaagggtgcggaccaggccggtggtaaaggcgttatttttaacaccattacgatttctgacggcattgccaacggcaccgaaggaatgaagtattccctggtgtcgcgggaagtcatcgcagattccattgaaaccgtggccggttgcgagggttttgacggcctggttgccattggcggctgtgacaaaaacatgcccggctgcatcatgggcctggcgcggcttaaccggcccagcgtgtttgtttatggcggtactattttgcctggtgaaggtcacaccgacattatttcagtgtttgaagcggtgggcgcccatgccaaaggcgaactgtcgttgattgaagtgaagcatattgaagaaaccgccattcccggccccggttcctgtggcggcatgtacaccgccaataccatggcctcggccatagaagcactgggtatgagcctgcccggcagctcggcgcagaatgcggtgtcgaatgacaaaaaagccgattgcgaagccgccggtgccgcggtcatgaatctgttggatcgagatatcaaaccttccgacattatgactcagcacgcctttgagaacgccatcactgtgatcatcaccttgggtggttccaccaacgccgtactgcacctgattggtatggccaacacggcgggtgtagagctaaccctggatgacttcactcgcattggtaaaaaggttccattgttggcggatctgcgccctagcggccattacatgatgagcgaattggtggccattggcggcatccagccactcatgaaaatgctgctagacgccggcatgctccacggcgattgcctgacagtaaccggcaaaactctggccgaaaacctggccacggtagaaccttatgccgatggccagaaaatcattatgcctctggaccagcccattaaagcggaaagccacctgcgcattctgtttggtaatctggcgccggaaggctccgtggcaaaaattaccggtaaggaaggcacccactttaaaggtcgggcgcgggtgtttggttcggaagaagaagcccaagcacgaattctggacggcactgtggtggctggcgatgtgctggttatccgctatgaaggcccacgcggcggccccggcatgcgcgaaatgctgtcacccacctcggcgattatgggccgtgggctgggcagcgatgtggctttgataactgacggtcgtttctccggtggtagccacggcttcgtcgtaggccacattacgccggaagcgtttgatggcggccctattgccttggtgcaagacggcgacgaaatcgtgattgatgccgtggccgacactattgagctaaatgtcagtgacgacgaactgcagagccgtcgcgacgcctggcagcaaccgcaaccgcgttacacccgcggtgtgttagccaagtatgcgcgcaccgtgagttcggcgtcgaccggtgcagtgaccgacctgcccgagccttga

SEQ ID NO: 194 - protein, 563 aa, Marinobacter sp.
MSDTPQDPRRRYSAPVVDGVAKSASRSMLRAVGFNDEDFSKPQIGIASTWSMVTPCNSHINELADIACKGADQAGGKGVIFNTITISDGIANGTEGMKYSLVSREVIADSIETVAGCEGFDGLVAIGGCDKNMPGCIMGLARLNRPSVFVYGGTILPGEGHTDIISVFEAVGAHAKGELSLIEVKHIEETAIPGPGSCGGMYTANTMASAIEALGMSLPGSSAQNAVSNDKKADCEAAGAAVMNLLDRDIKPSDIMTQHAFENAITVIITLGGSTNAVLHLIGMANTAGVELTLDDFTRIGKKVPLLADLRPSGHYMMSELVAIGGIQPLMKMLLDAGMLHGDCLTVTGKTLAENLATVEPYADGQKIIMPLDQPIKAESHLRILFGNLAPEGSVAKITGKEGTHFKGRARVFGSEEEAQARILDGTVVAGDVLVIRYEGPRGGPGMREMLSPTSAIMGRGLGSDVALITDGRFSGGSHGFVVGHITPEAFDGGPIALVQDGDEIVIDAVADTIELNVSDDELQSRRDAWQQPQPRYTRGVLAKYARTVSSASTGAVTDLPEP

SEQ ID NO: 195 - DNA, 1680 bp, Pseudoalteromonas haloplanktis
atgacttctgaaaaaccacgtaaatattcacaaaaaattgtagatggtagcgctcaggctcctagtcgttctatgttacgagcggtaggttttaatgatgacgattttaaaaagtctcaagttggtattgcctctacatggtctatggtaacgccgtgcaatatgcacattaatacacttgccgaagaagtaggtaaaggcgtagatagcgccggtgcgaaaagcgttatatataataccattaccgtatccgatggtatttctatgggcaccgaagggatgaaatattctttagtatcacgcgaagtaatttgcgactcaatagaagcggtatcggcgggtatgggccacgacggtattattgctattggcggttgtgataaaaatatgccgggttgtttaatgggtttagcacgtttaaaccgcccctctatatttgtgtacggcggtacaattttacccggtgaaaatcataccgatatagtctcggtatttgaagcggtgggcagctacgcggcaggcgatattccaattacgcaattagaacatattgaaaaaacagccataccaggggctggttcgtgtggtggtatgtacacggcaaatacgttagcctcagcaattgaagctttaggcatgagtatgccaaatagttctgcgcaaaatgctatttcacaaaacaaaaaacaagactgtattgatgcgggtaaagcgattgtttatttgctagagcatgacattaaaccttccgatattatgaccaaaaaagcgtttgaaaatgcaattacgctgatcattaccttaggcggctcaaccaatgcggtgctgcatttaatcgctatggctgatgcggtaggcgttgaagtaacattggatgactttgtgcgtattggcgataaaacaccagtaattgccgacttgcgtcccagcggtcaatatttaatgtcggagttgattgaaattggtggcattcaaccactgatgaagcgtttattagatgccggtatgctgcacggtgactgtatgacagtgacaggcaaaaccatggccgaaaatttagccgatgtagcagattacccagcagggcaaaatattattttaccttttgataagccgattaaaaaagacagccatttagttatattagctggtaatttagcgccagaaggggcagtgtcaaaaattacgggtaaagagggtttacgctttaccggcaacgcaaaagtatatgactcagaagagcaaggttttgccgctattatagatgggcaagtagtagccggagacgttgtagtaattcgctatgaaggccctaaaggtggcccaggtatgcgtgaaatgctaagccccacttcagctattatgggtaaaggtttaggtaacgatgtggcgcttattaccgatggtcgtttttcaggtggtagtaggggttttgttgtggggcacgttacaccagaagcttacgaaggcggcgccattgcactagtagaaaatggtgacagcattactattgacgcgcaaagccgtgaaatgactcttaatattactgatgaagaaatggccagtaggaaacaacgttggcaacaacctgcgccaaaatacacccgcggattactagcaaaatatgccagaacagtaagttcagcttctaccggagccgtgaccgataagccaagttaa

SEQ ID NO: 196 - protein, 559 aa, Pseudoalteromonas haloplanktis
MTSEKPRKYSQKIVDGSAQAPSRSMLRAVGFNDDDFKKSQVGIASTWSMVTPCNMHINTLAEEVGKGVDSAGAKSVIYNTITVSDGISMGTEGMKYSLVSREVICDSIEAVSAGMGHDGIIAIGGCDKNMPGCLMGLARLNRPSIFVYGGTILPGENHTDIVSVFEAVGSYAAGDIPITQLEHIEKTAIPGAGSCGGMYTANTLASAIEALGMSMPNSSAQNAISQNKKQDCIDAGKAIVYLLEHDIKPSDIMTKKAFENAITLIITLGGSTNAVLHLIAMADAVGVEVTLDDFVRIGDKTPVIADLRPSGQYLMSELIEIGGIQPLMKRLLDAGMLHGDCMTVTGKTMAENLADVADYPAGQNIILPFDKPIKKDSHLVILAGNLAPEGAVSKITGKEGLRFTGNAKVYDSEEQGFAAIIDGQVVAGDVVVIRYEGPKGGPGMREMLSPTSAIMGKGLGNDVALITDGRFSGGSRGFVVGHVTPEAYEGGAIALVENGDSITIDAQSREMTLNITDEEMASRKQRWQQPAPKYTRGLLAKYARTVSSASTGAVTDKPS

SEQ ID NO: 197 - DNA, 1686 bp, Acinetobacter sp.
atgagtaaagacaatatacgccagtattcggcaccagtttatgacggtattgaaaatgcccctgcacgttcgatgatgcgtgctgtgggctttcaagataaagattttaatcgtccatttattggcattgcttcaacatgggccaatgtcacgccgtgcaacatgcacattgatggactggcacgagaagctgaacatggggtgaatcaggccagcggtaagggaattatttttaacactattaccatttctgacggtatttcaaacggtaccgaaggcatgaagtattctttggtttctcgtgaaattattgcagactctattgaggcggtcattggttgtcagggttacgatggtgtaattgccattggtggctgcgacaaaaacatgcctggctgtattatggggctggcacgtttgaaccgtccaggcttgtttatttatggcggcaccattcaaccaggtgaaggacataccgacatgatttcggtgtttgaagcggtgggacagtacgccaaaggagaaatcaatgccattcaggtcaagcagattgaagaagtcgctttaccaggaccaggttcttgcgggggaatgtataccgccaataccatggcttctgctattgaagcactgggaatgagtttaccaggttcttctgcacaggatgccatttctgaagaaaagcgtcaggactgtcatcgtgcgggcgaggcggtgatgaacctgcttcggctggatattcgtccacgcgatattatgaccaaagcggcatttgagaatgccattaaggtcgtcattgctttgggcggttcaaccaatgccgtattgcatttgattgcaatggcacatacggctgaggtaaagcttgatctggatgattttgtacgaattggtcaggaaacacctgtggtggcagatttacgaccatcgggtaagtatctcatgtccgaactgatcaagattggtgggattcagccgttgatgaagcgaatgctggaacgcggcatgctggatggtagttgtctgactgtaactggtaagacccttgcagagaatttggccgaggttgaggattatcctgccgatcaacaaattatcttgccatttgagcaacctgttaagaaagactcccatctagtgattcttaagggtaatttgtccccgacaggtgccgttgccaaaattacgggcaaagaaggtttatattttgaagggccagcccgcgtttttgaaggcgaagaaggcgccatgcgtggcattctagacggagaagtacaagagggcgaagttgtcgtcattcgtggtgaaggacccaaaggtggaccaggcatgcgcgaaatgctgaaaccaacgtctgcaattattggtaaaggactgggacaatcggtggcgctgattaccgatgggcggttttcgggcggcagtcatggctttgtcattggccatgtgaccccagaagcttacgaaggtgggcctattggtttggttgaaaatggtgataaaatttcaatcaatgctgaaacgcgtgaaatcaccttacatatttctaacgaagaaatgagcttacgtcgtgcaaaatggcagaaaccagaaccaaaatataaatctggtgctttggcaaaatttgcaaaacttgcagcaggtgcggacaaaggcgcagttactgatttaaatcttgatgtgtaa

SEQ ID NO: 198 - protein, 561 aa, Acinetobacter sp.
MSKDNIRQYSAPVYDGIENAPARSMMRAVGFQDKDFNRPFIGIASTWANVTPCNMHIDGLAREAEHGVNQASGKGIIFNTITISDGISNGTEGMKYSLVSREIIADSIEAVIGCQGYDGVIAIGGCDKNMPGCIMGLARLNRPGLFIYGGTIQPGEGHTDMISVFEAVGQYAKGEINAIQVKQIEEVALPGPGSCGGMYTANTMASAIEALGMSLPGSSAQDAISEEKRQDCHRAGEAVMNLLRLDIRPRDIMTKAAFENAIKVVIALGGSTNAVLHLIAMAHTAEVKLDLDDFVRIGQETPVVADLRPSGKYLMSELIKIGGIQPLMKRMLERGMLDGSCLTVTGKTLAENLAEVEDYPADQQIILPFEQPVKKDSHLVILKGNLSPTGAVAKITGKEGLYFEGPARVFEGEEGAMRGILDGEVQEGEVVVIRGEGPKGGPGMREMLKPTSAIIGKGLGQSVALITDGRFSGGSHGFVIGHVTPEAYEGGPIGLVENGDKISINAETREITLHISNEEMSLRRAKWQKPEPKYKSGALAKFAKLAAGADKGAVTDLNLDV

SEQ ID NO: 199 - DNA, 1737 bp, Opitutaceae bacterium
atgaagccgacgaccgccaagaccaagcctgccacagccgccaagaccgccaacgccacgcgccagttctcctccatcgtgcacgacggagccgaccgcgcccccaatcgctccatgctccgcgccgtcggattcggcgatgcggatttcaagaaaaccgtcgtcggcgtcgcctccacctggtcgatgctcaccccgtgcaacatgcacatcaacaagctcgccgaatacgccgagcagggcgccaacgaagccggcggcaagggcatcatcttcggcaccatcaccatcgccgacggcatcagcatgggaacgcccggcatgcgctactcgctcgtgtcccgcgaagtcattgccgactccatcgaaaccgtggttggcggcgaaggttttgacggccttgtcgccatcggcggctgcgacaaaaacatgcccggctgcgttatggccatggcccgtctcaaccgccccagcgttttcgtttacggcggcaccattcttcccggcatccacccggaaaccaaaaaggacctcgacatcgtttccgtcttcgaagccgtcggccagcacgccgcgggcaagatcaacgacgctgcgctcaaggttgttgaggaatgctccatccccggtcccggttcctgcggcggtatgtataccgccaatacaatggccaacgccatcgaagccctcggcctctcgctgcccaattcctccgcgcaaatcgccatctccaaggaaaaacaagaagactgtcgccgcgccggagccgctgtcgttgaactcgcaaaaaaggggattcgtccgcgtgacattttaaccaaaaaagcctttgaaaacgccatcactgtagtgatcgccctcggtggctcaaccaatgccgtcctgcacctcctcgccatcgcgcacactgccggcgtgaagctcaccatcgacgacttcacccgcatcggcaaacgcgtgcccgtgctcgccgatctcaaaccttcgggcaaatacggcatggtgcatctctctcgcatcggcggcgtgcctccgctcatgaagaccttgctcgaccgcggtctcatccacggcgactgcctcaccgtcaccggcaagaccgtggcggaaaacctcaaggacgtgcagccgtatccagaaaatcaggacgtgatccgtccctttgaccaaccgatcaagcccgacagccacctgcgcattctctacggcaacctcgccgccgagggttccgtggccaagatctccggcaaggaaggcttaaagttttccggcaaagccatcgtgttcgagggagaggaggccgcgttgtctgccatcctcgacggacgcgtgaagtccggccacgtcgtcgtgatccgcaatgagggtcccgtgggcggccccggcatgagggagatgctcgcccccaccagcgccatcatgggcaagggactcggcaaggaagtcgcgctcatcaccgacggacgtttttcgggcggttcgcacggatttgtggtcggccacatcacacccgaggcggcgattggcggcaccatcggcgtcgtgaaaaacggcgacccgatcaccatcgacgccgtaaaaaaccagatcacgctcgacattcccgcgaaggaaatcgccgcgcgcaaaaagacctggaagccacgcaagccctacaccaatcgcggtgtgttggcgaagtatgccaaactcgtcagcaccgccagcgaaggcgcggtgacggacaagtatttgtaa

SEQ ID NO: 200 - protein, 578 aa, Opitutaceae bacterium
MKPTTAKTKPATAAKTANATRQFSSIVHDGADRAPNRSMLRAVGFGDADFKKTVVGVASTWSMLTPCNMHINKLAEYAEQGANEAGGKGIIFGTITIADGISMGTPGMRYSLVSREVIADSIETVVGGEGFDGLVAIGGCDKNMPGCVMAMARLNRPSVFVYGGTILPGIHPETKKDLDIVSVFEAVGQHAAGKINDAALKVVEECSIPGPGSCGGMYTANTMANAIEALGLSLPNSSAQIAISKEKQEDCRRAGAAVVELAKKGIRPRDILTKKAFENAITVVIALGGSTNAVLHLLAIAHTAGVKLTIDDFTRIGKRVPVLADLKPSGKYGMVHLSRIGGVPPLMKTLLDRGLIHGDCLTVTGKTVAENLKDVQPYPENQDVIRPFDQPIKPDSHLRILYGNLAAEGSVAKISGKEGLKFSGKAIVFEGEEAALSAILDGRVKSGHVVVIRNEGPVGGPGMREMLAPTSAIMGKGLGKEVALITDGRFSGGSHGFVVGHITPEAAIGGTIGVVKNGDPITIDAVKNQITLDIPAKEIAARKKTWKPRKPYTNRGVLAKYAKLVSTASEGAVTDKYL

SEQ ID NO: 201 - DNA, 1683 bp, Flavobacterium sp.
atggaattaaataaatacagtaaaactgtaactcaagacccaacattgcctgcggctcaagcaatgctgcacgcaataggtttaaccgatgaagatctcaagaaaccattaattggtatcgcaagtactggttatgaggggaatccttgtaatatgcaccttaatgatttggcaacctacgtcaagaaaggtgcgtctaatgcagatttagtcggacttattttcaatacgatcggtgtaagtgatggtatttctaacggaactccgggaatgcgtttctcgctgccgtcacgtgatatcatcgctgattctatggaaaccgtggttcaagcaatgagttatgacggtctggttacagttgtgggctgtgataaaaatatgccgggggcattaattgcgcaattgcgattaaatcgcccgtcaattttagtttatggaggaacgatcgcttccggatgccataacggaaaaaaactagatatcatttctgcttttgaggcttatggtcaaaaagttgcaggaactattgatgataatgagtttaaagaagtagtacacaaagcgtgtccgggtgccggtgcttgtggtggtatgtatactgcaaatactatggcttctgctattgaagctttaggaatgtcattgccttttaactcatcgaaccctgcagttactgatgctaatattaaagagcaggaatgtattaaagcaggtgaggctttaaaatatttattagagcaggatattaaaccttcagatattgtaacaaaagagtcgctcgagaatgcgattcgcttggtgactgttttgggaggttctaccaacgcagtattgcactttttagcaatagctaaagcagctcaggtagattttacgctagaagattttcagcgcctgagtgataatacaccgttgttagcagatcttaaaccttcaggtaaatattctatggaagatttacacggtgttggcggaattccgggagtattaaaatatatgcttgataacggtatgcttcacggggattgtttaaccgttaccggaaaaactttagctgaaaacctaaaagatgttcccaatcttatagatggtcaggatattattagaccgttgaataagccaattaaagatagtggccatatccgtatactattcgggaacttggctactgaaggagctgtagcaaagattaccggtaaggaagggctttcgtttacaggaactgccaatgtattcaacagcgaattagaggtaaacgaaggaattaaatcaggaaaagttaaaaaaggtgacgtagtgatcattcgctatgaaggacctaaaggtggtcccggaatgccagaaatgcttaagcctacctcttcaattatgggagccggtttaggtaaagacgttgctttgattactgacggaagattctctggtggatcgcacggatttgtggtggggcacgtttctcccgaagcacaagtgggtggaaatatcgcacttgtagaaaatggagatgtcatttctattgatgccgtaaagaataccatcaacatcgatattaccgatgaagaattggcaaaacgaagagaaaaatggacagctccggaacttagattccaacgcggagcgttatataaatatgcgaaaacagtctcgtcagcttctaaaggttgtgtgacagacgaaatgtag

SEQ ID NO: 202 - protein, 560 aa, Flavobacterium sp.
MELNKYSKTVTQDPTLPAAQAMLHAIGLTDEDLKKPLIGIASTGYEGNPCNMHLNDLATYVKKGASNADLVGLIFNTIGVSDGISNGTPGMRFSLPSRDIIADSMETVVQAMSYDGLVTVVGCDKNMPGALIAQLRLNRPSILVYGGTIASGCHNGKKLDIISAFEAYGQKVAGTIDDNEFKEVVHKACPGAGACGGMYTANTMASAIEALGMSLPFNSSNPAVTDANIKEQECIKAGEALKYLLEQDIKPSDIVTKESLENAIRLVTVLGGSTNAVLHFLAIAKAAQVDFTLEDFQRLSDNTPLLADLKPSGKYSMEDLHGVGGIPGVLKYMLDNGMLHGDCLTVTGKTLAENLKDVPNLIDGQDIIRPLNKPIKDSGHIRILFGNLATEGAVAKITGKEGLSFTGTANVFNSELEVNEGIKSGKVKKGDVVIIRYEGPKGGPGMPEMLKPTSSIMGAGLGKDVALITDGRFSGGSHGFVVGHVSPEAQVGGNIALVENGDVISIDAVKNTINIDITDEELAKRREKWTAPELRFQRGALYKYAKTVSSASKGCVTDEM

SEQ ID NO: 203 - DNA, 1680 bp, Cellulophaga sp.
ttgaaagaacttaataaatatagtaaagcggtaactcaagatcctacgcagccagctgctcaggcaatgttgcacgctataggacttacagatgaagattttaaaaagccacttgtaggtattgcaagtacaggttatgagggtaatccttgtaatatgcacttaaataaccttgcactagatattaaaaaaggagtacaaacttctgatctggtaggtcttatttataataccataggtgtaagtgacggtatctcaatgggtactcctggtatgcggtactcactacctagtagagatattattgcagactcaatggagactgtagtacaagctatgtcttatgatgcactggttacagtggtaggttgtgataaaaatatgccgggtgctcttatggcacagcttaggctagatagaccatctatactcgtctatgggggaactatagcaccaggatttcacgaagataaaaagctagatgtagtgtctgcttttgaagcttggggagaaaaagtagctggtagtattacagagcaagagtttaaaacggtggtaaaaaaagcctgtccaggtgctggtgcgtgtggtggtatgtatactgcaaacacgatggcaagcgcgattgaggcactagggatgagcttaccctatacaagttctaaccctgcagtgtcacctaataaaactgcggagtgtgctagagtaggagctgctttaagaaacctaatagaaaaagacataaaaccctcagacattgttactcgcaagtcactagagaatgcggtgagacttgtaaccgtacttggaggatctactaatgctgtgctgcactttctcgctatagcaaaggctgcacaagtatcatttacactagaagattttcaaaaaataagcgacaccacaccttttctagcagatcttaaaccatcaggaaaataccttatggaagatttacataatgtaggaggagtgccgggcgtattaaagtatatgctagagcaaggtatgttgcacggtgactgtatgaccgtaactggtaaaactattgcagagaatctagcagttgtagaccatcttcaggcacatcaagatgttattcattcggttgagaatcctattaaagagacgggacacattcgtattctttatggaaatattgcaagtgaaggatctgtggcaaaaattacaggtaaagagggattacattttcgcggaagcgcaagagtttacaacggtgagtatgctgcaaacgcgggtataggtgcaggagaggtgaaaaagggtgatgtagtagttatacgctacgaagggccacaaggaggaccgggtatgccagaaatgctcaaacctacagcggctattatgggtgctggcttaggtaaggatgtggcacttattacagatggacgtttttctggaggtacacacggctttgttgtggggcacattactccagaggctcaagtaggtggtgggattgcgcttatagaaaatggagataccattgtgattaacgctgagactaacacaattaatgttgagataagtgagagcgaactagaagcacgtaaaaagaactgggtagctccagagcttaaagtaaaacgtggctcactttataaatatgctcgtatggtctcatctgcgagtgagggatgcgtgacagacgagttctag

SEQ ID NO: 204 - protein, 559 aa, Cellulophaga sp.
MKELNKYSKAVTQDPTQPAAQAMLHAIGLTDEDFKKPLVGIASTGYEGNPCNMHLNNLALDIKKGVQTSDLVGLIYNTIGVSDGISMGTPGMRYSLPSRDIIADSMETVVQAMSYDALVTVVGCDKNMPGALMAQLRLDRPSILVYGGTIAPGFHEDKKLDVVSAFEAWGEKVAGSITEQEFKTVVKKACPGAGACGGMYTANTMASAIEALGMSLPYTSSNPAVSPNKTAECARVGAALRNLIEKDIKPSDIVTRKSLENAVRLVTVLGGSTNAVLHFLAIAKAAQVSFTLEDFQKISDTTPFLADLKPSGKYLMEDLHNVGGVPGVLKYMLEQGMLHGDCMTVTGKTIAENLAVVDHLQAHQDVIHSVENPIKETGHIRILYGNIASEGSVAKITGKEGLHFRGSARVYNGEYAANAGIGAGEVKKGDVVVIRYEGPQGGPGMPEMLKPTAAIMGAGLGKDVALITDGRFSGGTHGFVVGHITPEAQVGGGIALIENGDTIVINAETNTINVEISESELEARKKNWVAPELKVKRGSLYKYARMVSSASEGCVTDEF

SEQ ID NO: 205 - DNA, 1680 bp, Kordia algicida
atgaacaatctcaataaatacagcaaaacagtcacacaagatcctacgcaacctgcggcacaagccatgttgcatgccattggattaacgaaagaagactttttcaaacccatcatcggaattgcaagtacaggttacgaaggaaatccgtgcaacatgcacctaaacgatctggcaaaactggcaaaacaaggaacaaaaaatgaggaggttgtcggacttattttcaatacaattggcgtaagtgatggaatctccatgggaacaccaggaatgcgttattcattgccttcacgcgatatcattgccgattctatggaaacggtagtgcaagcaatgagttatgacggattaatcacggttgttggttgtgacaaaaacatgccaggcgcactaatggcaatgattcgcctaaatcgcccaagtatcttagtctatggcggaaccattgattctggttgtcacaacggaaaaaaactcgatgttgtttctgcttttgaagcttggggaagcaaagttgcaggaactatggacgaaacagaataccaaaacattgttgaaaaagcgtgtccaggtgctggtgcttgtggcggaatgtacaccgcaaacaccatggcttctgctatagaagcattgggaatgacattaccattcaattcatcaaatcctgcgttgagcgatgctaaaaaacaagaatcggttgcggcgggcgaagcaatgcgtgttttgttagaaaaagatatcaaaccatcagacattattactcgaaaatctttggaaaatgcagttcgtttagtaacaattttgggcggatcaaccaatgcagtattacacttcttagcaattgccagagctgcacaaattgatttcacactcaaagactttcaagaaataagcgatgaaacgccgtttttggcagacttaaaacctagtggaaaatacttaatggaagacgtacacgctgtcggcggaattcctgcggtattaaaatatttactcaaaaaaggattgcttcatggcgattgtttaacggttacgggaaaaacaatggcagaaaatttattagatgtcgatgacttaacagaaggtcaagatgtcatcaaacctgtggaaaatccaataaaaatatcaggacacttacgcatgctttatggaaacctagcaagtgaaggaagcgtggcaaaaatcacaggaaaagaaggtttaaaattctctggaaaagcaaaagtatttgaaggtgaatacgaagccaatgacggaattcgtgatggaaaagtgcaaaaaggagacgtcgtcgtcattcggtatgaaggaccaaaaggcggaccaggaatgccagaaatgctaaagccaacagcagcaatcatgggtgcaggtttaggaaaagatgttgcattaattactgatggacgcttttctggaggaacacacggttttgtcgtcggacacatcacgccagaagcacaagaaggcggaacacttgctttagtaaaagatggcgatatcattaccattgatgcagaaacgaatacgatacaattagaagtttcaaacgaagaacttcaagaacgtaaaaaacaatggaaagcacccgaactcaaatttgaacgcggtgtattatacaaatatgcaaaaacagtttcatctgcatccaaaggttgcgtaactgatgaattttag

SEQ ID NO: 206 - protein, 559 aa, Kordia algicida
MNNLNKYSKTVTQDPTQPAAQAMLHAIGLTKEDFFKPIIGIASTGYEGNPCNMHLNDLAKLAKQGTKNEEVVGLIFNTIGVSDGISMGTPGMRYSLPSRDIIADSMETVVQAMSYDGLITVVGCDKNMPGALMAMIRLNRPSILVYGGTIDSGCHNGKKLDVVSAFEAWGSKVAGTMDETEYQNIVEKACPGAGACGGMYTANTMASAIEALGMTLPFNSSNPALSDAKKQESVAAGEAMRVLLEKDIKPSDIITRKSLENAVRLVTILGGSTNAVLHFLAIARAAQIDFTLKDFQEISDETPFLADLKPSGKYLMEDVHAVGGIPAVLKYLLKKGLLHGDCLTVTGKTMAENLLDVDDLTEGQDVIKPVENPIKISGHLRMLYGNLASEGSVAKITGKEGLKFSGKAKVFEGEYEANDGIRDGKVQKGDVVVIRYEGPKGGPGMPEMLKPTAAIMGAGLGKDVALITDGRFSGGTHGFVVGHITPEAQEGGTLALVKDGDIITIDAETNTIQLEVSNEELQERKKQWKAPELKFERGVLYKYAKTVSSASKGCVTDEF

SEQ ID NO: 207 - DNA, 1680 bp, Flavobacteriales bacterium
atgagtcaattaaacaaatacagtaaaactgttacacaagatccaacgcagccagctgctcaagcaatgcttcatgctattggattaactaaagaagatttttataaacctattgtaggaattgcaagtacaggttacgaaggtaacccttgtaatatgcacctcaatgacctagcgaaattggtcaaagaaggcacaaagaatgaagatgtcgtcggcttaattttcaacacaattggtgtaagtgatggcatttctatgggaacaccaggaatgcgttactcattaccttcaagagatattattgcagattctatggaaactgtagtacaagccatgagttatgatggtttagtcactgtagttggttgcgacaagaatatgcctggagccttaatggctatgataagattaaatcgtccttcgattttagtttatggaggcacaattgattctggttgtcataatgggcaaaaattagatgttgtttctgcatttgaagcttggggaagcaaagttgcaggtactatgaccgaaaatgaataccaaaatatagttgaaaaagcatgtcctggagctggtgcttgtggaggtatgtacacagcaaacacaatggcttctgctattgaggctctaggtatgacattaccttttaactcttctaatccagccttaagtgatgcaaagaaagaagagtctgtaaaagctggagaagctttaagagttttactcgaaaaagatattaagccttcagatattataactagaaaatcacttgaaaatgcagtaagattagttaccatattaggtggctctacaaatgctgtattacactttttagccattgcaagagcagctcaaattgatttcacattaaaagattttcaagatataagtgataacactccattcttagcagatttaaaaccaagtggaaaatacttaatggaagatgtacatgctgtaggaggaattcctgcggtattaaaataccttcttaaaaaaggattaattcacggagattgtttaaccgttaccggaaagacaatagctgagaatttattagatgttgctgacttaaccgaaggtcaagacgtcatcaaacccatcgaagaaccaattaaaatttctggacacttaagaatgctctacggaaacctagccactgaaggtagtgttgcgaaaattactgggaaagagggcttaagttttaaagggaaagcaaaagtatttgaaagtgaatatgatgcaaacgatggcattagagatggaaaagtagaaaaaggtgatgtcgtagtcattcgatacgaaggtccaaaaggagggcctggaatgccagaaatgctaaagccaactgctgctattatgggagctggtttaggtaaagatgtagccttgattactgatggaagattctctggaggaactcacggttttgtcgttggacacatcacacctgaagcacaagaaggcggcactcttgcttttgttgaagatggagatattattacaattgatgccgaaaccaatacgatttcagtagaagtatctgaacaagaattacaaaaaagaagaaaaaattggaaagctccagatttaaaatttgaacgtggagtactttataaatatgcaaagacagtatcatcagcttcaaaaggctgtgttactgatgaattttaa

SEQ ID NO: 208 - protein, 559 aa, Flavobacteriales bacterium
MSQLNKYSKTVTQDPTQPAAQAMLHAIGLTKEDFYKPIVGIASTGYEGNPCNMHLNDLAKLVKEGTKNEDVVGLIFNTIGVSDGISMGTPGMRYSLPSRDIIADSMETVVQAMSYDGLVTVVGCDKNMPGALMAMIRLNRPSILVYGGTIDSGCHNGQKLDVVSAFEAWGSKVAGTMTENEYQNIVEKACPGAGACGGMYTANTMASAIEALGMTLPFNSSNPALSDAKKEESVKAGEALRVLLEKDIKPSDIITRKSLENAVRLVTILGGSTNAVLHFLAIARAAQIDFTLKDFQDISDNTPFLADLKPSGKYLMEDVHAVGGIPAVLKYLLKKGLIHGDCLTVTGKTIAENLLDVADLTEGQDVIKPIEEPIKISGHLRMLYGNLATEGSVAKITGKEGLSFKGKAKVFESEYDANDGIRDGKVEKGDVVVIRYEGPKGGPGMPEMLKPTAAIMGAGLGKDVALITDGRFSGGTHGFVVGHITPEAQEGGTLAFVEDGDIITIDAETNTISVEVSEQELQKRRKNWKAPDLKFERGVLYKYAKTVSSASKGCVTDEF

SEQ ID NO: 209 - DNA, 1704 bp, Psychroflexus torquis
ttgatttttgaaaatgaaacagatacaatggaactaaataagtatagcaaaaccgttactcaagatcctactcaaccagctgctcaagctatgctgcatgctataggtctaactaaagaagatttttttaagcctatcattggtattgctagtactggatacgaagggaatccttgtaatatgcatttaaacgatctcgctaaactcgctaaacaagggacagcaaatgaagatattataggtttaatatttaataccataggggtgagtgatggaatttctatgggcacaccaggaatgcgttactctctaccttctagggatatcatcgcagactccatggaaactgttgttcaagctatgagttatgatggtttaattactgtcgtaggctgcgataaaaacatgcccggtgcattaatagcgatgattcgactcgacagaccttgcattatgatttatggaggaaccatcgattctggttgtcataatggaaaaaaattggacgtggtttccgcttttgaagcttggggaagtaaagtggctggaaccatgcaagaagaagaataccaaagcattgtagaaaaagcgtgtcctggagctggtgcttgtggagggatgtatactgctaatacgatggcctcttctatagaagctttaggaatgactttaccttataattcttccaatccagcgcttagtccagaaaaaaaacaagagtctattaaagcaggtgaagctttgagagttttattggaaaaagacatcaaaccttcagatataattacaagaaaatctttagaaaatgccatacggttaattacaattttaggaggatctacaaatgctgttttacattttttagcaattgctagagccgctgaaattgatttcactttaactgattttcaaacgattagcgataatactccttttttagcagacttaaaaccgagtggtaagtaccttatggaagatttacatgaggtaggtggaattccagcagttttgaaatatttgcttaaaaaaggccttatttatggagactgcctaaccgttacaggaaaaactttagcagaaaatttacgtgatgtagaggatcttaaagaaggtcaggaggtcatcaaaccaatagaaagccctattaaaatctcaggacatctaagaatgctctttgggaatttagctgaagagggcagtgttgctaaaattacaggaaaagaaggtttaaaatttcgaggaaaggccaaggtttttgaaggggaatacaaagctaatgacggaattagagatggaaaagttcaaaaaggagatgtagtggttatccgttatgaaggccctaaaggaggtccaggtatgccagaaatgctgaaacctactgctgcaataatgggagcagggttaggcaaagatgtcgctttgattaccgatggaagattctctggaggaactcatggttttgtagttgggcatatcactccagaagcccaagaaggcggcacgattgcccttgttgaagaaggggattatatcactattgatgccgagacaaacagtatcaatttagaagtatctgatgaggagctcatcaaaaggaaaaaaaattggaaggcaccaaatttaaaatttaaacgaggtgttctttataaatatgcgagaatggttaattctgcatcaaaagggtgcgtaacagacgaattttaa

SEQ ID NO: 210 - protein, 567 aa, Psychroflexus torquis
MIFENETDTMELNKYSKTVTQDPTQPAAQAMLHAIGLTKEDFFKPIIGIASTGYEGNPCNMHLNDLAKLAKQGTANEDIIGLIFNTIGVSDGISMGTPGMRYSLPSRDIIADSMETVVQAMSYDGLITVVGCDKNMPGALIAMIRLDRPCIMIYGGTIDSGCHNGKKLDVVSAFEAWGSKVAGTMQEEEYQSIVEKACPGAGACGGMYTANTMASSIEALGMTLPYNSSNPALSPEKKQESIKAGEALRVLLEKDIKPSDIITRKSLENAIRLITILGGSTNAVLHFLAIARAAEIDFTLTDFQTISDNTPFLADLKPSGKYLMEDLHEVGGIPAVLKYLLKKGLIYGDCLTVTGKTLAENLRDVEDLKEGQEVIKPIESPIKISGHLRMLFGNLAEEGSVAKITGKEGLKFRGKAKVFEGEYKANDGIRDGKVQKGDVVVIRYEGPKGGPGMPEMLKPTAAIMGAGLGKDVALITDGRFSGGTHGFVVGHITPEAQEGGTIALVEEGDYITIDAETNSINLEVSDEELIKRKKNWKAPNLKFKRGVLYKYARMVNSASKGCVTDEF

SEQ ID NO: 211 - DNA, 1677 bp, Flavobacteriales bacterium
atggaattgaataaatacagtaaaaacgttacccaagaccccacacaaccagctgctcaagcaatgttgtatgccataggttttaaagatgaagattttaaaaaaccattagttggtatcgcaagtacgggatatgagggcaacccttgtaacatgcatttgaatgatttggccaaattggtcaaggacggcgtgaattcaaaggaaacggttggtttgattttcaatacaattggggtgagtgatggaatatccatgggaactcctggaatgcgtttttcattaccatcaagggatattattgccgattcaatggaaacggttgtccaaggaatgtcgtatgacgccttggtaacggtggtaggctgtgataaaaatatgccgggagcattaatggccatgttaagattgaataggccatcaatattggtatacggcggtacaattgcctctggatgtcataatgatagaaaattggatattgtttctgcttttgaagcttggggagaaaaagtggctggtaccatggaggagtctgagtataaaagtataataaggaaagcgattcctggggcaggtgcttgtggtggtatgtacacggcaaataccatggcttcagccattgaagctttgggaatgtcattgccttataattcttccaaccctgcagacaattatctcaaagagaatgaatgtattgaagcaggtaagcaaatgcgcgtacttattgagaaagatattaaaccactggacattgtaactcgtaagtcattggaaaatgcgattcgtttagttactatcatgggtggctcaacaaatgcagtattacatttcttggcaattgctagagccgcagatatagaatttacactacaagattttcaacatattagtgatacaacaccttttattgcagatttaaagccaagtggcaaatatttaatggaagatgtgcaccgtgtaggtggtataccggctgtattgaaatatttattgaaaaacggacttttacatggggattgtttaacggttactggcaagacattggctgaaaatcttgaaaatgtcccagatttagaagaggggcaagatgtaattatgcctttggacaaaccaataaaagcaaccggacatttacgcatgctttatgggaatctggcagaaaatggttcagttgcaaaaattacgggaaaagaaggtttggtgtttaaaggaactgccaaagtgtttaatagcgagtatgacgccaatgatggtattcgaactggattggtgaaaaagggtgatgttgttgtaattcgatatgaagggcctaaaggaggtcctggaatgccagaaatgttgaaaccaacagcagcaattatgggagctggtttaggaaaagaagtagccttgattacagatggtcgtttttcaggaggaacacacggttttgtagtaggacatatttcacccgaagctcaagaaggtggtacaattggtttggttaaaaatggtgacataattaccattgatgctgaaactaattcaatcaatgttgctgtttctgatgaagaattggcaaaacgaaagaccgaatgggtacaaccagaattaaaattcaaaaagggcgtgctttataaatatgcgcgttcggtttcatctgctgcggaaggttgcgtaacggatgagttttaa

SEQ ID NO: 212 - protein, 558 aa, Flavobacteriales bacterium
MELNKYSKNVTQDPTQPAAQAMLYAIGFKDEDFKKPLVGIASTGYEGNPCNMHLNDLAKLVKDGVNSKETVGLIFNTIGVSDGISMGTPGMRFSLPSRDIIADSMETVVQGMSYDALVTVVGCDKNMPGALMAMLRLNRPSILVYGGTIASGCHNDRKLDIVSAFEAWGEKVAGTMEESEYKSIIRKAIPGAGACGGMYTANTMASAIEALGMSLPYNSSNPADNYLKENECIEAGKQMRVLIEKDIKPLDIVTRKSLENAIRLVTIMGGSTNAVLHFLAIARAADIEFTLQDFQHISDTTPFIADLKPSGKYLMEDVHRVGGIPAVLKYLLKNGLLHGDCLTVTGKTLAENLENVPDLEEGQDVIMPLDKPIKATGHLRMLYGNLAENGSVAKITGKEGLVFKGTAKVFNSEYDANDGIRTGLVKKGDVVVIRYEGPKGGPGMPEMLKPTAAIMGAGLGKEVALITDGRFSGGTHGFVVGHISPEAQEGGTIGLVKNGDIITIDAETNSINVAVSDEELAKRKTEWVQPELKFKKGVLYKYARSVSSAAEGCVTDEF

SEQ ID NO: 213 - DNA, 1677 bp, unknown
  unidentified eubacterium SCB49
atggaattaaataaatatagtaaacgcgttactcaagacgattcacaacctgcagcaaaagctatgcttcatgctattggtttgagtaaagaagacttagataaaccatttgttggtattgcgagtacaggttatgaagggaatccttgtaatatgcatttaaacgatttagcgcttgaagtaaaaaaaggtacaaaaaataaagatttagtaggcctaatttacaataccattggtgtgagtgatggtatttctatgggaacacctggaatgagatattccctaccctctagagatgtaattgcagattcaatggaaacggtagtagaaggaatgtcttatgatgcacttgttacggtagtaggttgtgataaaaatatgcctggagctttaatggctatgttacgtactaaccgacctggcgttttagtttatggaggcaccattgcttctggatgtcataatggtaaaaaattagatgtcgtttctgcttttgaatcttgggggcaaaaagttgctggaaaaatagatgaaaaagaatatcaagatgtcattgaaaaggcatgtcctggtgcaggtgcttgtggtggtatgtataccgcaaacacaatggcatctgctatagaggcattaggaatggcattaccatataactcttctaaccctgctttaggaacagaaaaaaaagcagaatgcataaaagctggcgaagctgtccgtttactccttgaaaaagacattaaacctaaagatattgtcacaaaaaaagcattagaaaatgccatcaggttagtaacaataatgggaggatctacaaatgccgtgttacattttttagcgattgctagaaccactgatgttgaatttacattagaggatttccaaaaaatatctgataccactccttttttagcagatttaaaacctagtggtcagtacttaatggaagatgtccatgcggttggaggaacacctgctgttttaaaatacttattaaaaaatggcttattacatggagattgtctaactgtaacaggaaaaacattggctgaaaacctccaagatgtacccgatttattagaaaatcaaaaggttataaaatcaataaacaaccctattaaagagacagggcatttaagaatattaagaggaaatttatcaccagaaggtgctgttgcaaaaattacaggaaaagagggctttaaatttacaggtaccgcaaaagtttttgattctgaatatgacgccaatgatggcattagagatggtaaagtacaaaaaggcgatgttgtagttattagatatgaaggtcctaaaggtggtcccggaatgccagaaatgctaaagcctacagcagcaattataggagctggattaggtaatgatgtagctttaattacagatggaaggttttctggtggtacgcacggttttgtagttggtcatatttcgccagaagcacaagtaggcggtcctattgcttttgtacaaaacggagatgagataactatcgacgccattaaaaataccatagactttaatatttccgaagaagttttagaaaaacgtaaagcagcctggaaacaacccgatttaaagtataaaaaaggggttttatataaatatgccagaactgtatcatgtgcatctaaaggttgcgtaacagatgaattttaa

SEQ ID NO: 214 - protein, 558 aa, unknown
  unidentified eubacterium SCB49
MELNKYSKRVTQDDSQPAAKAMLHAIGLSKEDLDKPFVGIASTGYEGNPCNMHLNDLALEVKKGTKNKDLVGLIYNTIGVSDGISMGTPGMRYSLPSRDVIADSMETVVEGMSYDALVTVVGCDKNMPGALMAMLRTNRPGVLVYGGTIASGCHNGKKLDVVSAFESWGQKVAGKIDEKEYQDVIEKACPGAGACGGMYTANTMASAIEALGMALPYNSSNPALGTEKKAECIKAGEAVRLLLEKDIKPKDIVTKKALENAIRLVTIMGGSTNAVLHFLAIARTTDVEFTLEDFQKISDTTPFLADLKPSGQYLMEDVHAVGGTPAVLKYLLKNGLLHGDCLTVTGKTLAENLQDVPDLLENQKVIKSINNPIKETGHLRILRGNLSPEGAVAKITGKEGFKFTGTAKVFDSEYDANDGIRDGKVQKGDVVVIRYEGPKGGPGMPEMLKPTAAIIGAGLGNDVALITDGRFSGGTHGFVVGHISPEAQVGGPIAFVQNGDEITIDAIKNTIDFNISEEVLEKRKAAWKQPDLKYKKGVLYKYARTVSCASKGCVTDEF

SEQ ID NO: 215 - DNA, 1689 bp, Gramella forsetii
atggataaaacagcaatgaacaacaaatatagtagtacaataacacaaagtgattctcaacctgcctcacaggcgatgcttcacgctataggattaaataaagaagatctcaaaaaaccttttgtgggaattgggagtaccggttacgaagggaatccctgtaatatgcaccttaatgaccttgctaaagaggtgaaaaaaggaactcagaatgccgatttaaacggacttattttcaatacaataggcgttagtgatgggatttccatgggaacgccgggaatgcgattctcactgccttccagagatctaatcgcagattctatggaaactgttgtaggaggaatgtcttacgatggcctggttactgtagtgggttgcgataagaatatgcccggtgccttaatggctatgttgagactgaacaggccttctgtgctggtgtatggcggaacgatcgcttccggttgccataatggtaaaaaactggatgtggtgtctgcatttgaagcctggggctcaaaagtttcaggggatatgcaggaagaagaatatcagcaggtaattgaaaaagcctgtccgggggcaggagcctgtggagggatgtatactgcaaatacaatggcctcctctatcgaagctttagggatgagtctgccgttcaacagttccaatcctgcaaccggacctgagaaaactcaggaaagtgtaaaagcaggggaggcgatgaaatatttgctggagaatgatctaaaaccaaaagatatagtgaccgcaaaatcactggagaatgcaattcgactattaacggtgcttggtggttctaccaatgccgtacttcattttcttgcgatagcaaaagctgcagagatcaattttggattaaaagattttacaagaatatgtgaggaaacgcctttcctggcagatttgaagcctagcgggaaatacctgatggaagatattcacaggattggaggaatcccggctgtgatgaaatatatgcttgaaaaaggactgcttcatggcgaatgtatgacagttaccggaaaaacgattgccgaaaatcttgaaaatgtaaagccattacctgacgatcaggatgtaattcaccctgtcgaaaaacctatcaaagctaccggacacatcagaattttatacggaaatctggcttctgaaggctccgttgccaaaataacgggaaaagaaggattggaatttcaaggaaaagcaagagtgtttaatggtgaatttgaagctaacgaagggatttcttcgggcaaggttcaaaaaggggatgtggtcgtcattcgctatgagggtcctaaaggaggacctggaatgccagaaatgctgaaaccaacttcggccattatgggcgccggactagggaaaagtgtagcccttatcaccgacggaaggttctcgggaggaactcatggctttgtggtgggacacattactcctgaggctcagcaaggcggactcattggtctgttgaaggatggtgacgagataagtattaatgccgagaaaaatactattgaggcacatctttcagcagaagaaataaatagaagaaaagaagcctggaaagctcccgctttaaaggtgaacggaggagtactctataaatacgcaaaaacggtagcatcagcttcagaaggctgcgtaacagatgaattttaa

SEQ ID NO: 216 - protein, 562 aa, Gramella forsetii
MDKTAMNNKYSSTITQSDSQPASQAMLHAIGLNKEDLKKPFVGIGSTGYEGNPCNMHLNDLAKEVKKGTQNADLNGLIFNTIGVSDGISMGTPGMRFSLPSRDLIADSMETVVGGMSYDGLVTVVGCDKNMPGALMAMLRLNRPSVLVYGGTIASGCHNGKKLDVVSAFEAWGSKVSGDMQEEEYQQVIEKACPGAGACGGMYTANTMASSIEALGMSLPFNSSNPATGPEKTQESVKAGEAMKYLLENDLKPKDIVTAKSLENAIRLLTVLGGSTNAVLHFLAIAKAAEINFGLKDFTRICEETPFLADLKPSGKYLMEDIHRIGGIPAVMKYMLEKGLLHGECMTVTGKTIAENLENVKPLPDDQDVIHPVEKPIKATGHIRILYGNLASEGSVAKITGKEGLEFQGKARVFNGEFEANEGISSGKVQKGDVVVIRYEGPKGGPGMPEMLKPTSAIMGAGLGKSVALITDGRFSGGTHGFVVGHITPEAQQGGLIGLLKDGDEISINAEKNTIEAHLSAEEINRRKEAWKAPALKVNGGVLYKYAKTVASASEGCVTDEF

SEQ ID NO: 217 - DNA, 1677 bp, Robiginitalea biformata
atgaacctgaacaaatacagtaaaaacgtcacacaggaccccacccaaccggcagcgcaggccatgctttatgccattggcctgaccgaggaggaccttgaaaaacccctgatcgggattgccagcaccgggtatgaaggcaacccgtgcaacatgcacctgaacgatctggcgctgcacgtgaaggaaggcgtgaaccgctccgatctggtagggctgattttcaatacgatcggggtgagtgacgggatatccatgggaacctacgggatgcgttattccctcccttcccgggatattattgccgattccatggagaccgtggtccaggcgatgaactacgacggcctggtaactgtagtgggctgtgacaagaacatgcccggggcgctgatggcgatgatccgcctgaaccgcccctccgtaatggtttacgggggaaccattgcatccggttgcctgaacaaccggaaactcgatgtggtatcggcttttgaggcctggggccagaaagtggccgggaatatgcaggaggaggaatacaaacaagtaatccagaacgcctgcccgggagctggtgcctgtggcgggatgtatacggccaacacgatggcatcggctatcgaagccctggggatggccctgccttacaactcttcgaacccagccaccggttcggaaaagcaggaagattgcacccgcgccggccaggcggtgcgcaccttgctcgaaaaagatatcaagccgctcgacattattacaaaaaagtccctggagaatgccatccgcctcgtagtggtgatgggggggtccacgaatgccgtcctgcacttcctggccattgccaaggcagcgcgcgtaccgtttaccctggacgatttccagcggatcagtgacgaaacgccctttttggcagacctgaagcccagcggcaaatacctgatggaagatgtccaccgggtgggcggcgtgcctgccgtccttaaattcctgctcgctgaaggcatgctccacggggattgcctgacagttactggaaaaacccttgccgagaacctaaaggatgtcccggatctggaagccggtcaggaggttatccggcccctttccgacccgatcaagaaaaccgggcacctgcgtatcctgtacgggaacctcgcacccacaggttcggttgccaaaatcaccgggaaggagggactccggttccagggacccgcccgcgtatttgaggacgaatttgaagcaaaccggggcataggcgaaggcaaagtttcccggggggatgtggtagtcatccgctacgaaggtccccagggtgggcctggtatgcccgaaatgctcaagcccaccagtgccatcatgggggccggcctgggcaaggatgtggccctgatcaccgatggccgcttttcgggtggtacccacggatttgtagtggggcatgtaacacccgaagcacaggccggaggcccgattgccctgctccgggacggggacatcatcaccatcgacgccgaagccaatacgctttcggtagacctgagcgacgaggagctcaaccggcggcgggcagcctggaaggcccctgaactaaaggtgaagcggggcagcctgtacaaatatgccaaaacggtttcatcggcctctgaaggctgtgttaccgatgaaatttga

SEQ ID NO: 218 - protein, 558 aa, Robiginitalea biformata
MNLNKYSKNVTQDPTQPAAQAMLYAIGLTEEDLEKPLIGIASTGYEGNPCNMHLNDLALHVKEGVNRSDLVGLIFNTIGVSDGISMGTYGMRYSLPSRDIIADSMETVVQAMNYDGLVTVVGCDKNMPGALMAMIRLNRPSVMVYGGTIASGCLNNRKLDVVSAFEAWGQKVAGNMQEEEYKQVIQNACPGAGACGGMYTANTMASAIEALGMALPYNSSNPATGSEKQEDCTRAGQAVRTLLEKDIKPLDIITKKSLENAIRLVVVMGGSTNAVLHFLAIAKAARVPFTLDDFQRISDETPFLADLKPSGKYLMEDVHRVGGVPAVLKFLLAEGMLHGDCLTVTGKTLAENLKDVPDLEAGQEVIRPLSDPIKKTGHLRILYGNLAPTGSVAKITGKEGLRFQGPARVFEDEFEANRGIGEGKVSRGDVVVIRYEGPQGGPGMPEMLKPTSAIMGAGLGKDVALITDGRFSGGTHGFVVGHVTPEAQAGGPIALLRDGDIITIDAEANTLSVDLSDEELNRRRAAWKAPELKVKRGSLYKYAKTVSSASEGCVTDEI

SEQ ID NO: 219 - DNA, 1677 bp, Tenacibaculum sp.
atggaattaaataaacatagcaaaagattaacccaagacgaatctcaaccagcttctcaagccatgttgtatgcagtaggtttatcagaagaagatatgagcaaagcccaagttggtattgcaagtacaggttatgatggtaatccatgtaatatgcatctaaacaatttagctgcagaagttaaagtagaaagtaaaattgctggtttagttgggttaggttttaatactattggagtttcagacggaatttctatgggaacttctggtatgaattattctttagcttccagagatataattgcagattcaatagaaactgtaatgaatgctcaaagttatgatgccttagtttctgtggtaggttgtgacaaaaatatgccaggagctgtaattgcaatgttacgtttaaataggccatcaattatgatgtatggaggtacaattgcctctggtagttataaaggtaaaaaattaaatattgtatctgcctttgaagctttaggtcaaaaagtagctggagaaatagatgagaatgaatacaaagaaattataaaaagagccattccaggagcaggtgcttgtggaggtatgtatactgcaaatacaatggcttctgcaatagaatgtatgggttttgctttgccttataattcttctattccagcagaaaatccaaataaactatctgaagcagaaagaacagctttagctattaaaaacttattagagttagatttaaaacctttagatatcatttctaaaaagtcgttagaaaatgctgttgctttagtaaatgctttgggtggatctacaaatgcagttttacactttttagctatagcacatgcagcagaaatagattttactttagaagattttcaaaaagtatcagatagaacgcctttaattgcagatttgaaaccatcaggaaaatatttaatggaagatgttcatggagttggaggtacgcctgcaattatgaaatatttattggataatgggtatttgcatggagattgcttaactgttacaggtaaaactttagcagaaaacttggcagatgttaaagcaatggagtttgaagctcaagatgttatttatccaaaagataaagctttaaaaacgtcaggaaacattcaaatcatttatggaaatctagcaacagaaggtgcagtagctaaaatttctggaaacgaaggcttgttgtttgaaggtaaagctgtggtttacgatggtgagcaagcagcaaatacaggtatttctaatggtgaagtagaaaaaggtgatgtagttgttattagatatgtggggccaaaaggtgggccaggaatgccagaaatgttaaagccaacttctttaattatgggagcaggtttaggtaaatctgtagctttaataacagatggacgtttttctggaggtacacatggttttgttgtggggcatattacaccagaagcacaatcaggaggagctattgggcttttagaaacaggtgataaaattagaattagtgcagaagacaactcaataaatgtgcttatttctgatgaagagttagagaaaagaagagcaaattgggtggctcctgctttaaaacataaaaaaggaattttatacaagtacgcaaaatctgtagcctctgcatctaaaggatgtgttactgatttataa

SEQ ID NO: 220 - protein, 558 aa, Tenacibaculum sp.
MELNKHSKRLTQDESQPASQAMLYAVGLSEEDMSKAQVGIASTGYDGNPCNMHLNNLAAEVKVESKIAGLVGLGFNTIGVSDGISMGTSGMNYSLASRDIIADSIETVMNAQSYDALVSVVGCDKNMPGAVIAMLRLNRPSIMMYGGTIASGSYKGKKLNIVSAFEALGQKVAGEIDENEYKEIIKRAIPGAGACGGMYTANTMASAIECMGFALPYNSSIPAENPNKLSEAERTALAIKNLLELDLKPLDIISKKSLENAVALVNALGGSTNAVLHFLAIAHAAEIDFTLEDFQKVSDRTPLIADLKPSGKYLMEDVHGVGGTPAIMKYLLDNGYLHGDCLTVTGKTLAENLADVKAMEFEAQDVIYPKDKALKTSGNIQIIYGNLATEGAVAKISGNEGLLFEGKAVVYDGEQAANTGISNGEVEKGDVVVIRYVGPKGGPGMPEMLKPTSLIMGAGLGKSVALITDGRFSGGTHGFVVGHITPEAQSGGAIGLLETGDKIRISAEDNSINVLISDEELEKRRANWVAPALKHKKGILYKYAKSVASASKGCVTDL

SEQ ID NO: 221 - DNA, 1677 bp, Polaribacter irgensii
atggaattaaacaaacatagcaaaagattaacacaagatgaatctcaaccggcatcacaagcaatgttgtacgctgtaggtttaacagatgaggacatgcagaaggcgcaaattggtattgcaagtactggatatgacggaaatccttgtaatatgcatttaaatcatctaaaagaagaggttaaagtagagtgtaatattgcgggtttagtcggtttagggttcaatacaattggggtgtcagatggaatttctatgggaacttcaggcatgaattattctttagtttcaagagatatcatagcagactctatcgaaacggttatgaatgcacaaagttacgatgcagtaattgctattgtgggttgtgataaaaatatgccaggatcagtgattgccatgctgcgtttaaatcgccctgcgataatgatgtatggcggctcgactgcatcgggaaattacaaaggaaaaaagttaaatattgtttccgcttttgaggctttaggtcaaaagatgtctggagaaattgaagaagaagagtatcgagaaataattaagagggccattccaggcgctggagcgtgtggtggtatgtacactgcaaatacaatggcttctgcgattgaatgtatggggttctcattgccttataattcttcaattccggcagaaaatccgaataaattgtctgaagcggaaagaactgccttggcgattaaaaacttactagaattagatttaaaacctttagatattatttctaagaaatctttagaaaatgccattacccttgtaaatgcgttaggagggtcaacaaatgccgtcttgcatttcttagcaattgcgcacgctgcagatattgagtttactttagaggattttcaaagagtgagtgacagaacaccattaattgcagatttgaaaccatcaggaaaatatcttatggaagatgtgcataatattggaggcacacctgcgatcatgaaatatttattagaaaatgactatttgcacggggattgtttgacggttacaggaaaaacattggctgagaatttagcaaatgttaaggcgatggaatttgaagagcaagatgtgatttacccaaaagagaacgcattaaaatcatcaggaaatattcaaataatttatggaaacctagcaactgaaggagcagtagcaaaaatatctggaaacgaagggctactttttgaaggaaaagctgtcgtgtatgatggtgagcaagctgcaaatacagggattacaaatggagaggtagaaagaggagatgtcgtcgttattagatacgtgggtcctcgaggaggtccaggaatgccagaaatgctgaaacctacgtccttaattatgggtgcaggtttaggaaagtctgtagcattaattacagatggaagattttctggaggaacacatggctttgttgttggacacattacaccagaagcacaatcgggaggaaccattgggattttaaaaactggcgatacaattagaattagtgcagaagataattctattaatgttttaatttctgaggatgaaattgcagcaagaaaagtaaaatgggttgcacccgcactaaagcatacaaaaggaattttgtataaatatgcaaaaacagtagcatccgcatctaaaggatgtgtaacagacttataa

SEQ ID NO: 222 - protein, 558 aa, Polaribacter irgensii
MELNKHSKRLTQDESQPASQAMLYAVGLTDEDMQKAQIGIASTGYDGNPCNMHLNHLKEEVKVECNIAGLVGLGFNTIGVSDGISMGTSGMNYSLVSRDIIADSIETVMNAQSYDAVIAIVGCDKNMPGSVIAMLRLNRPAIMMYGGSTASGNYKGKKLNIVSAFEALGQKMSGEIEEEEYREIIKRAIPGAGACGGMYTANTMASAIECMGFSLPYNSSIPAENPNKLSEAERTALAIKNLLELDLKPLDIISKKSLENAITLVNALGGSTNAVLHFLAIAHAADIEFTLEDFQRVSDRTPLIADLKPSGKYLMEDVHNIGGTPAIMKYLLENDYLHGDCLTVTGKTLAENLANVKAMEFEEQDVIYPKENALKSSGNIQIIYGNLATEGAVAKISGNEGLLFEGKAVVYDGEQAANTGITNGEVERGDVVVIRYVGPRGGPGMPEMLKPTSLIMGAGLGKSVALITDGRFSGGTHGFVVGHITPEAQSGGTIGILKTGDTIRISAEDNSINVLISEDEIAARKVKWVAPALKHTKGILYKYAKTVASASKGCVTDL

SEQ ID NO: 223 - DNA, 1698 bp, Pedobacter sp.
atgtcaacaacaccagaattaaaccgctatagcaaaacattcactcaagatcctacacaacctgccgcacaggccatgttgtatgggattggcctaacaaaagaggacctcgacaaagcccaggtaggcattgccagcatgggttacgatggaaacacctgtaacatgcacctgaacgacctcgctcaggtggtaaaaaaaggcgtctgggacaacggaatggttggcctgaccttcagcaccatcggtgtgagtgatggaatgtctaatggtacagacggaatgcgttactccctggtatccagagatgtcatcgccgattctattgagaccatctgtggcggacagtattatgatggtgtcatcaccattcctggatgtgacaaaaatatgccgggatccatcattgccatgggacgtctgaaccgcccctcgatcatggtatatggtggaagtatccactccggaaactataaaggcaaagccctgaacattgtttctgcttttgaagcattgggtcagaaacttgccggtaacatcgaagaagaagattatcaaggcatcatccgccatacctgccctggtgcgggtgcatgtggggggatgtataccgcaaatactatggcctctgcaattgaagcaatgggcatgagtttgccttatagctcctcctaccctgctaccagtcaggagaaaaaggatgaatgtatcaatgctgccaaagcaatccgtgttttgctggagagaaacattcttccaagtgacatcatgaccgagaagtcattccacaacgccatcgtaacggtgatggtactaggtggatctaccaatgccgtactccacctgattgcaatggccaaatctgtaggcctgaacctgaagatcgatgatttccaggacgtaagtaacaatactccggtacttgccgatttaaaacctagtggtacttacctgatggaagacctgcatgaaattggtggtgttcctgcagtattaaaatatctattgaaagaaggactgttgcatggcgactgtatgacggtaacgggtaaaacccttgctgagaatgtggctgatgccgtagacctggatttcgatcagcaaaagatcatcttcccggtcagcaacccgctaaaaacaactggtcacctgcagatcctgtatggcaacattgctcaaaaaggatcagtagcaaaaatcagtggtaaagaaggcgagaaatttgaaggccctgcacgtgtatttgacggggaaaaatcgttgatcgcaggaatcctgagtggacgtgtacgccagggtgatgtggtcgtgatcagacaggtaggccctaaaggagctcctggaatgcctgaaatgctgaaaccgacatctgccatcattggcgccggactgggtaaatcggttgccctgatcactgacggaaggttctccggaggtacacatggtttcgtagtgggacacatcactcctgaagcatgggatggtggaaacatcgcctttgttaatgatgatgacatgattaccattgatgcagtcaacaataccattaacctgaagatctctgatgaggaaatggctaaacgtaaggcagaatggaaacagttgcctccgccagtgaaaagcggtgtattgtacaaatacatcaagcaggttagtgatgccagcgaaggatgtgttactgacgcctacacacattaa

SEQ ID NO: 224 - protein, 565 aa, Pedobacter sp.
MSTTPELNRYSKTFTQDPTQPAAQAMLYGIGLTKEDLDKAQVGIASMGYDGNTCNMHLNDLAQVVKKGVWDNGMVGLTFSTIGVSDGMSNGTDGMRYSLVSRDVIADSIETICGGQYYDGVITIPGCDKNMPGSIIAMGRLNRPSIMVYGGSIHSGNYKGKALNIVSAFEALGQKLAGNIEEEDYQGIIRHTCPGAGACGGMYTANTMASAIEAMGMSLPYSSSYPATSQEKKDECINAAKAIRVLLERNILPSDIMTEKSFHNAIVTVMVLGGSTNAVLHLIAMAKSVGLNLKIDDFQDVSNNTPVLADLKPSGTYLMEDLHEIGGVPAVLKYLLKEGLLHGDCMTVTGKTLAENVADAVDLDFDQQKIIFPVSNPLKTTGHLQILYGNIAQKGSVAKISGKEGEKFEGPARVFDGEKSLIAGILSGRVRQGDVVVIRQVGPKGAPGMPEMLKPTSAIIGAGLGKSVALITDGRFSGGTHGFVVGHITPEAWDGGNIAFVNDDDMITIDAVNNTINLKISDEEMAKRKAEWKQLPPPVKSGVLYKYIKQVSDASEGCVTDAYTH

SEQ ID NO: 225 - DNA, 1680 bp, Flavobacteria bacterium
atggaattaaataaatatagtaaaacaataacacaagatccttctcaacctgcttctcaagcaatgttatatggaattggtttaactgaagaacaactagcaaaaccttttataggaattgcttcaatgggttatgatggaaatacttgtaatatgcatttaaatcatttagcagctttaattaaaaaagaagttaatgctaatgatatggtgggtttaattttcaacacaattggtattagtgacggtattactaacggaactgatggaatgcgttattctctagtaagtagagaaattattgcagatagtattgaaagtgttgtttcaggtcattactatgatggtgtaatttctattcctggttgtgataaaaatatgccaggaagtattattgcaatgggaagattaaatcgtccatcgataatggtttatggtggtacaattgcaccaggaaaataccaaggtaaagatttgaatattgtttcggcatttgaagcattaggagaaaaaattgcgggtactatttctgaagaagactataaaggaattataaagaattcatgtccaggtgcaggagcttgtggcggcatgtatacggcaaatacaatggctattgctattgaagcattaggaatgagcttaccttattcaagttcaaatcctgctataagtcatgataaaatagaagaatgtgaatctgccgctggatatttaaaattattattagaaaaaaatatttgtccaaaagacattatgacgtttgaagcatttgaaaatgctattaccgttttaattgctctaggaggaagtacaaatgccgttttgcatatgattgcaatggcaaaaagtgttggagtagctataagtcaggataattttcaacgattaagcaatacaactccattaattgccgattttaaaccgggtggaaattatttaatgcaaaacctacatgaaaaaggtggtgtgccaatggttttaaaatatttgctttctaaaggaatgttacatggaaattgtattacggtaacaggtaaaactttagcagaaaatttagaagcagtaatagatattgattttaacgatcaaaatattattcgtcagatagagaatccaataaaaactacagggcatcttcaaattttatatggaaatcttgctttaaaaggttccgtagcaaaaataacaggtaaagaaggcgaattttttaaaggtccagctcgtgtttttgatggtgaaaaagaattaataaaaggtatcgaagataaaaaaataaaagctggcgatgtcgtagttatacgatatgtaggtccgaaggggggacctggaatgcccgaaatgctaaagccaacatcagccttaattggtgctggtttaggaaaaagtgttgcattaattaccgatggtcgttttagtggaggaactcatggttttgtagtaggtcatatttcacctgaagcttatgatggaggtacaattgctttagttgaagatgaagatattatagaaattaatgctgttgataataccattcatttacatgttggtgatgaagaattagcgaatagaaaaagtaaatggaatcaaccaaaattaaaagtaactaatggtgtgttattaaagtatgcaaaattagttacagatgcttcaaatggttgtgtaaccgatgaatattag

SEQ ID NO: 226 - protein, 559 aa, Flavobacteria bacterium
MELNKYSKTITQDPSQPASQAMLYGIGLTEEQLAKPFIGIASMGYDGNTCNMHLNHLAALIKKEVNANDMVGLIFNTIGISDGITNGTDGMRYSLVSREIIADSIESVVSGHYYDGVISIPGCDKNMPGSIIAMGRLNRPSIMVYGGTIAPGKYQGKDLNIVSAFEALGEKIAGTISEEDYKGIIKNSCPGAGACGGMYTANTMAIAIEALGMSLPYSSSNPAISHDKIEECESAAGYLKLLLEKNICPKDIMTFEAFENAITVLIALGGSTNAVLHMIAMAKSVGVAISQDNFQRLSNTTPLIADFKPGGNYLMQNLHEKGGVPMVLKYLLSKGMLHGNCITVTGKTLAENLEAVIDIDFNDQNIIRQIENPIKTTGHLQILYGNLALKGSVAKITGKEGEFFKGPARVFDGEKELIKGIEDKKIKAGDVVVIRYVGPKGGPGMPEMLKPTSALIGAGLGKSVALITDGRFSGGTHGFVVGHISPEAYDGGTIALVEDEDIIEINAVDNTIHLHVGDEELANRKSKWNQPKLKVTNGVLLKYAKLVTDASNGCVTDEY

SEQ ID NO: 227 - DNA, 1677 bp, Flavobacterium psychrophilum
atgaacacaataaacaaatacagtaaaaccataacgcaagacgaaacccaaccagcagcacaagccatgctttatggaatagggttaacggaagcagatatgtataaagcacaagtaggaattgtaagtacaggttatgaaggtaatacttgcaatatgcacttgaacgatttagccaaagacgtaaaatttggagttgcatctgaaaatttagtcggattaatatttaatactataggcgtaagcgatggtatctctaacggtacagatggtatgcgattttcattggtatctcgagacataattgcagactctatagaaacagtggttagtgcacaatggtacgatgccgttttagccgtagtgggatgtgataaaaatatgcctggatctgtcatggctatgggaagactaaatcgacctgctataatgatatatggtggtagtattcattctggaaaatggaaaggagaatccttaaatattgtgtcggcttttgaagctttgggaaaaaaatttaacaatacaataaccccagaagattttaaaggtgttataaaaaacgcttgtccaggtgcaggtgcttgtggcggaatgtacaccgcaaacaccatggcttccgcaattgaagctttgggaatgagcttaccatatagttcgtctaatccagctttgagccaagaaaagaaacaagaatgtttagatgcaggcaaagcaatccgagttttattagaaaaagacatcaaacctaaagacatcatgaccaaaaaagccttcgaaaatgcaatgacgatggtggtggttcttggtgggtctacaaatgccgttttgcatttaatagccatggcacattcagtagatatagaattaaccctgcaagacttccaaaaaacaagtaacaacattcctgttttagcagatttaaaaccaagcggaaaatacctcatggaagatttacacgcagtgggaggggttcctgcggttatgaaatatttgctagaaaacaagctgttacacggtgattgcttaacagtaacagggaaaacagtagccgaaaatttagcaaatatccctagtttacatcaaggacaaactgtttttcttcctctaaaaacgccactaaaagccacaggacatttgcaaatcctttacggaaacctagcgccagaagggagtgttgcaaaaataagcggcaacgaaggtgatttctttgaagggaaagccaaagtttataatgatgaatataccgtgattgatggcgtaaaaaacggagaggttgcctctggagatgtagttgtaattagatattgcggaccaaaaggaggaccgggaatgccagaaatgctaaaacctacttccgcaataatgggagctggtttaggaaaaaatgtagcattaataaccgacggaagattctcggggggaactcatggttttgtagtggggcatattacacctgaagcttacgacggaggaaccattgcgctagtaaaagatggtgatacaattaccattaatactaaaaataacaccattcaattaaaagttagcgaagaagaattaaccaaaagaaaatccgaatggaaacaacctaaacttaaagctaccaaaggtgttttgtataaatatgcccaatgtgtttcaagtgcatctaaaggttgtgtaaccgataattaa

SEQ ID NO: 228 - protein, 558 aa, Flavobacterium psychrophilum
MNTINKYSKTITQDETQPAAQAMLYGIGLTEADMYKAQVGIVSTGYEGNTCNMHLNDLAKDVKFGVASENLVGLIFNTIGVSDGISNGTDGMRFSLVSRDIIADSIETVVSAQWYDAVLAVVGCDKNMPGSVMAMGRLNRPAIMIYGGSIHSGKWKGESLNIVSAFEALGKKFNNTITPEDFKGVIKNACPGAGACGGMYTANTMASAIEALGMSLPYSSSNPALSQEKKQECLDAGKAIRVLLEKDIKPKDIMTKKAFENAMTMVVVLGGSTNAVLHLIAMAHSVDIELTLQDFQKTSNNIPVLADLKPSGKYLMEDLHAVGGVPAVMKYLLENKLLHGDCLTVTGKTVAENLANIPSLHQGQTVFLPLKTPLKATGHLQILYGNLAPEGSVAKISGNEGDFFEGKAKVYNDEYTVIDGVKNGEVASGDVVVIRYCGPKGGPGMPEMLKPTSAIMGAGLGKNVALITDGRFSGGTHGFVVGHITPEAYDGGTIALVKDGDTITINTKNNTIQLKVSEEELTKRKSEWKQPKLKATKGVLYKYAQCVSSASKGCVTDN

SEQ ID NO: 229 - DNA, 1674 bp, Flavobacterium johnsoniae
atggaattaaataagtacagcaaaaccatcactcaagatcaaacacagcctgcggcgcaagcaatgttgtatggaattggtttaactgaagaagatttaaaaaaagcacaagttggtattgtcagcatgggttatgatggtaatacttgcaatatgcacttaaatgatttagcaaaagatgttaaaaaaggtgtttgggatgctggtctggtcggacttatttttaataccattggtgtaagtgacggaatttctaacggtacagaaggaatgcgttattcattagtttctcgtgatgtaatcgcagattctattgaaactgtagccggtgcacaatggtacgatagtattattgcaattcctggctgcgataaaaatatgcctggagcattaatcgcaatgggaagattaaaccgtccgtcaatgatggtttatggaggatctatccactcaggaaaatggaaaggtgaatctctaaacatcgtttctgcttttgaagctttaggaaaaaaagtaaaaggcgaaattactccggaagattttaaaggtgttattcaaaatgcttgtcctggagctggtgcctgcggtggtatgtatactgcaaacactatgtcttctgcaattgaagcattaggtatgagtatgccttacagttcttctaaccctgctttgagtcaggaaaaaagagacgaatgtattgctgccggagaagctattaaagttttattagaaaaagatattaagccaagagatattatgactcgtaaagctttcgaaaatgctattacaattgtagcagttttaggaggttctacaaacgcagttatgcacttaattgcaatggcacactctgttggtattacaattactcttgatgattttcaggcaattaacgacagaacacctgttcttgccgatatgaaaccaagtggtaaatatatgatggaagacattcacgaagtgggaggtattccgggtgtaatgaaatatttattgaaagtgggacttatccacggagattgtttaacagtaactggaaaaacagttgctgaaaacttagcttctacaccggatttacaagacggacaagaagtaattcatgaaattcaaaaagcgttaaaaccaacaggaaatattcaggttttatacggaaaccttgcttctgaaggagctgtggcaaaaatcagcggaaaagaaggggaatatttcgaaggaccagctgttgtatttgaaggggaatttgaagtaattccaggcttgcaggccggaaagattaaaccaggtaatgtcgtcgtcattagaggttgtggaccaaaaggtggtccgggaatgcctgaaatgctaaaaccgacatctgccattattggtgcaggattaggaagcagctgtgcacttattacagacggcagattctccggaggttcacacggattcgtggtaggacacgtaacaccagaggcttatgatggaggtggtattgcactagtaaaagatggagatttaattgctatcgatgctgtaaaaaatacaatcgacctgaaaatatctgacgaagaatttgcagctcgtaaagcggcttgggttcaaccagcgctaaaagttgacagaggggttttacttaaatacgcaagatcggtttctagtgcttcaacaggctgtgttaccgataattaa

SEQ ID NO: 230 - protein, 557 aa, Flavobacterium johnsoniae
MELNKYSKTITQDQTQPAAQAMLYGIGLTEEDLKKAQVGIVSMGYDGNTCNMHLNDLAKDVKKGVWDAGLVGLIFNTIGVSDGISNGTEGMRYSLVSRDVIADSIETVAGAQWYDSIIAIPGCDKNMPGALIAMGRLNRPSMMVYGGSIHSGKWKGESLNIVSAFEALGKKVKGEITPEDFKGVIQNACPGAGACGGMYTANTMSSAIEALGMSMPYSSSNPALSQEKRDECIAAGEAIKVLLEKDIKPRDIMTRKAFENAITIVAVLGGSTNAVMHLIAMAHSVGITITLDDFQAINDRTPVLADMKPSGKYMMEDIHEVGGIPGVMKYLLKVGLIHGDCLTVTGKTVAENLASTPDLQDGQEVIHEIQKALKPTGNIQVLYGNLASEGAVAKISGKEGEYFEGPAVVFEGEFEVIPGLQAGKIKPGNVVVIRGCGPKGGPGMPEMLKPTSAIIGAGLGSSCALITDGRFSGGSHGFVVGHVTPEAYDGGGIALVKDGDLIAIDAVKNTIDLKISDEEFAARKAAWVQPALKVDRGVLLKYARSVSSASTGCVTDN

SEQ ID NO: 231 - DNA, 1713 bp, Lactococcus lactis
atggaattcaaatataacggaaaagttgaatcaatagagctcaataagtattcaaaaacattgacacaagacccaacacagccagcgacccaagccatgcactatggcattggttttaaagatgaggacttcaaaaaagctcaggtcggaatcgtcagcatggattgggacggaaatccctgtaacatgcacttgggcacactcggtagtaaaatcaaaaattctgtcaatcaaactgacggactgattgggcttcaatttcacacgattggggtttctgacggaattgccaacggaaagcttggcatgagatattccttggtcagtcgtgaagttattgctgacagtattgaaaccaacgctggcgccgaatattacgatgcaattgtcgctgttcccggttgtgacaaaaatatgccaggctcaatcattggcatggctcggctcaatcgtccgtcaattatggtttatggtggaacgattgaacatggcgaatacaaaggcgaaaagttaaatattgtttcggcttttgaagcgcttggacaaaaaatcactggaaatatttccgaggaagattatcacggcgtcatttgtaatgccattccgggacagggtgcttgtgggggcatgtatacagcaaatacactggcttcggcaattgaaactttgggaatgagtttgccttattcggcttcaaatccagcggtcagtcaagaaaaagaagacgaatgtgatgaaattggtctggcaatcaaaaatttgctagaaaaagacatcaaaccaagcgatatcatgaccaaggaagcttttgaaaatgccataacgatcgtcatggttctcggtggttcaactaatgctgtgcttcatatcattgccatggctaatgccatcggtgtcgaaattacgcaagatgattttcaacgtatttccgatgtcacgcctgtgcttggcgacttcaagccaagtggcaagtacatgatggaagatttgcacaaaattggtggcgtgcctgctgttttgaaatatttgctcaaagagggcaagcttcatggcgactgtttgacagttactggtaaaactctagctgaaaatgttgaaacagcactggatttggactttgacagccaagacattattcgaccacttgaaaatcctatcaaagcaacaggtcatttgcaaattctctatggcaatcttgctgaaggtggttctgtggcaaaaatttctggaaaagaaggggaatttttcaaaggaacagctcgtgtctttgatggcgaacaacattttattgacggaattgagtcaggtcgtttgcacgcaggagatgtcgctgtcattcgtaatatcggtccagtcggaggcccaggaatgccagaaatgttaaaaccgacctcagccttgattggagcaggtcttggaaaatcttgtgctttgattactgacggacgtttctctggtggcacacatggctttgtggttggccacattgtccccgaagcggttgagggtggattgattggcttggtcgaagatgatgatattatcgagattgatgcggtcaataacagcattagtttgaaagttgctgacgatgagattgctagacgacgtgccaattatcaaaaacctgctcctaaagcaacgcgtggggttcttgctaaatttgctaaactcacgcgcccagccagtgaaggctgtgtgactgatttatag

SEQ ID NO: 232 - protein, 570 aa, Lactococcus lactis
MEFKYNGKVESIELNKYSKTLTQDPTQPATQAMHYGIGFKDEDFKKAQVGIVSMDWDGNPCNMHLGTLGSKIKNSVNQTDGLIGLQFHTIGVSDGIANGKLGMRYSLVSREVIADSIETNAGAEYYDAIVAVPGCDKNMPGSIIGMARLNRPSIMVYGGTIEHGEYKGEKLNIVSAFEALGQKITGNISEEDYHGVICNAIPGQGACGGMYTANTLASAIETLGMSLPYSASNPAVSQEKEDECDEIGLAIKNLLEKDIKPSDIMTKEAFENAITIVMVLGGSTNAVLHIIAMANAIGVEITQDDFQRISDVTPVLGDFKPSGKYMMEDLHKIGGVPAVLKYLLKEGKLHGDCLTVTGKTLAENVETALDLDFDSQDIIRPLENPIKATGHLQILYGNLAEGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVADDEIARRRANYQKPAPKATRGVLAKFAKLTRPASEGCVTDL

SEQ ID NO: 233 - DNA, 1686 bp, Psychromonas ingrahamii
atgtcagaaataaataagtattcaaaaacagtgacgttagatgaatcacaaccggcttcacaggccatgctttatgctattggtttgaaagaagaggatatgaaaaaagcgcaagtgggtattgtttcaacaggatgggaaggaaatccatgcaatatgcacttaaacgaatttgctaaagacgtgaaaaaaagtgtgaacgcagctgatttggtgggattaatctttcacacaatcggagtgagtgatggtatttcaaacgggactaccgggatgaagtactctttagtgtctcgtgagatcattgctgattctattgaaacggttgtaagtgcgcaattttatgatgcgattgttgccattgtaggatgtgataaaaatatgcccggtgcaatgatggcattgtcgcgtttaaatcgtccgggaatattggtttatggcggttcggttaaagctggaaaatggaaaggtgaagacttgaatatcgtttctgctttcgaagcttatggaaaaaaattacagggtgttatctcccatgaagattataaaggggtaattcaaaatgcgatcccgggtccgggtgcttgtggtggaatgtatacggcaaatactatgtcttcagctattgaagcgttaggcatgagtttgccttactcttcatcgaacccggcggttagcgatgacaaaaaaagagaattaacaacagtgggtgatgcagttaaaaacctgctggaaaaagatattaaaccaaaagatattatgaccaaaaaagcgttcgagaatgccttaagaattattatgattttagggggctctaccaatgcaactttacatatgattgcaatggcccgatcatcaggtgttgacttgagtttagatgatttccaaaagatggcagataaaacgccattattggcaaatttaaaaccttccggggaattcctaatgcaagacttacatgaaatcggcgggatccctgcagtcatgaaatacttattggctgaaggtttattacatggggattgtttgaccgttacaggtaacaccattgctgaaaacttagctgatttacccggccttcctgatgatcaggacattatcagacctttgtctaaccccttgaaagaaactggccacttacagattctttatggaaacttggcacctgaaggttcagttgcaaagattacaggtaaagaaggcgaagtattcgaaggcccggcaagagtttatgaagatgaattttcagcaataaaaggtatcggagacgaagtgcaaaaaggtgaagttatcgttatccgttattcaggaccaaaaggtgcgcctggcatgccagaaatgctaaaaccaacttcagctgtaatgggggcgggtcttggaaaagacgtggcattaattacagatggcagattctccggaggttctcatggttttgttgttggacacgtgacgccagaggcatcggaaggtggattgattgccctggtccaaaatggagacatgatccgaattgattctgttactaacaaattggaattgaaagtcgatcaggctgaaatcaacaagcgtaaagctgcttggataaaaccagcttacagagcgacaaatggtgtactaagaaagtatatcgccacggtaaaatctgcctctctaggatgtgttaccgatgaaatagacgaactgtag

SEQ ID NO: 234 - protein, 561 aa, Psychromonas ingrahamii
MSEINKYSKTVTLDESQPASQAMLYAIGLKEEDMKKAQVGIVSTGWEGNPCNMHLNEFAKDVKKSVNAADLVGLIFHTIGVSDGISNGTTGMKYSLVSREIIADSIETVVSAQFYDAIVAIVGCDKNMPGAMMALSRLNRPGILVYGGSVKAGKWKGEDLNIVSAFEAYGKKLQGVISHEDYKGVIQNAIPGPGACGGMYTANTMSSAIEALGMSLPYSSSNPAVSDDKKRELTTVGDAVKNLLEKDIKPKDIMTKKAFENALRIIMILGGSTNATLHMIAMARSSGVDLSLDDFQKMADKTPLLANLKPSGEFLMQDLHEIGGIPAVMKYLLAEGLLHGDCLTVTGNTIAENLADLPGLPDDQDIIRPLSNPLKETGHLQILYGNLAPEGSVAKITGKEGEVFEGPARVYEDEFSAIKGIGDEVQKGEVIVIRYSGPKGAPGMPEMLKPTSAVMGAGLGKDVALITDGRFSGGSHGFVVGHVTPEASEGGLIALVQNGDMIRIDSVTNKLELKVDQAEINKRKAAWIKPAYRATNGVLRKYIATVKSASLGCVTDEIDEL

SEQ ID NO: 235 - DNA, 1677 bp, Microscilla marina
atgacagttttgaacaaatacagccgacgaattactcaggatgtaacccaaccagcctctcaagcaatgctgtatggcatagggcttactaaagaggatatgagcaagcctcaaataggcatagtaagtactggttatgagggcaatacctgcaacatgcacctcaatgatctggccttggaaaccaaaaaaggtactaaagaagcagacttggtagggttggtattccatactataggcgtaagcgacggaatatctaacggtaccgaaggaatgcgtttttcgttgccttcacgcgacattatcgccgactcgatagagactgtagtgcaggctcaatggtacgatgggatacttgctgtagtgggttgcgacaaaaacatgccgggagctatgatggctctggcgcgtttgaaccgtcctggactgcttgtttacggcggaagcatcaggtcaggctgtcacaaaggtcaaaaactcaatattgtgtctgcctttgaagcactcggacagcgttttaacggaagtttgaatgaagaagattatcaaggaattatccaaaactcttgccctggtgcaggagcttgtggcggtatgtatactgccaacacgatggcaacagtgatagaagctattggattgggcttaccttatggagcctctaatcccgcccaaagccctgaaaaacaacaagaatgtatagatgcgggcaaagctatgagaaagctgctcgaagaggacatcaaacccctcgacatattgaccaaaaaagcttttgaaaatgccttgacaatgatcatggtcatgggaggctctaccaatgcggtgctgcacatgattgccattgccaaagctgctgaggtggatctaagcctggaagattttcaacgtatcagcgacaaaactccttatttggcaaatctcaagcctagtggaaagtacttgatggaagacttgcacaccattggtggcacccctgctgtaatgaagctattgctggacgagggattgctacacggtgattgtttgacggtaacgggcaaaacgcttgctgagaatcttgctaacattgctccggtaaaagacgatcaggacgtgctgttcccaataagccaacctctaaaacctcagggacatttacaagtgttatttggcaacctggccacacaaggggcagtagctaaaattacgggcaaagagggagaaaaatttgaaggtactgccaaggtgtacgacggagagtttgaggctatcaaaggtattcaggacggagaagtaaaagctgggcacgtggtagtcattaggtacgaaggccccaagggtggtccgggaatgcctgaaatgctcaagcctacctctgcaataatgggtgccgggctgggcaatagcgtggcattgattacagatggtaggttttcgggtggttcacacggttttgtagtgggacacgtgtgccctgaagcacaggaaggtggcttgattgccttgcttaaggatggcgatcgaatcacgattgatgcggtagacaaccaaatggtggcgcacttatcagaggaagaaatagcccaacgacgcgcccaatggcaagcaccagaatcgcgctttacccgtggaattttaggcaaatatgcccgtactgtttcgtcggcctcggagggctgtgtaacggatgaatag

SEQ ID NO: 236 - protein, 558 aa, Microscilla marina
MTVLNKYSRRITQDVTQPASQAMLYGIGLTKEDMSKPQIGIVSTGYEGNTCNMHLNDLALETKKGTKEADLVGLVFHTIGVSDGISNGTEGMRFSLPSRDIIADSIETVVQAQWYDGILAVVGCDKNMPGAMMALARLNRPGLLVYGGSIRSGCHKGQKLNIVSAFEALGQRFNGSLNEEDYQGIIQNSCPGAGACGGMYTANTMATVIEAIGLGLPYGASNPAQSPEKQQECIDAGKAMRKLLEEDIKPLDILTKKAFENALTMIMVMGGSTNAVLHMIAIAKAAEVDLSLEDFQRISDKTPYLANLKPSGKYLMEDLHTIGGTPAVMKLLLDEGLLHGDCLTVTGKTLAENLANIAPVKDDQDVLFPISQPLKPQGHLQVLFGNLATQGAVAKITGKEGEKFEGTAKVYDGEFEAIKGIQDGEVKAGHVVVIRYEGPKGGPGMPEMLKPTSAIMGAGLGNSVALITDGRFSGGSHGFVVGHVCPEAQEGGLIALLKDGDRITIDAVDNQMVAHLSEEEIAQRRAQWQAPESRFTRGILGKYARTVSSASEGCVTDE

SEQ ID NO: 237 - DNA, 1689 bp, Cytophaga hutchinsonii
ttgattattgtgagtacagaattaaataaaataagtaaacgtttaacccaggatccatctcagcccgcatctcaggcaatgatgtatggagctgggtttacagacgaggatatgaaaaagccaatcgttggtattggcagtacaggtttcgatggtaacacatgtaacatgcacttaaatatccttgccggacaagttaaaggcagtattacgcgtggcggtatggttggacttggtttcaacacgatcggcgtaagtgatgggatttcaatgggtacagaagggatgcgtttctctcttgtatcacgcgacgtaattgcggattcaattgaaacaatttgtgaagctcattactacgatgcgttggtaaccgttgtaggttgtgataaaaacatgcctggcgcacttattgcaatggctcgcttgaatcgcccgtcaatcatggtatacggcggtacaattcactcaggtcactacaaaggcgaaaaactaaacatcgtttcagcttttgaagcattgggtaaaaaagtagccggcacaatcactgaagaagattaccagggtgtaattaaaaatgcatgtccgggtgcgggtgcctgtggtggcatgtacacagcaaacacaatggcatctgcaattgaagcaatgggattaacacttccttattcttcaacggcacctgcaacaagcgaaaagaaaaaggcagaaacattggcgcttggcaaagcaatgatgcatctgctggagaaagatatcaagccgcgtgatatcatgacattcgaggcatttgaaaatgctatccgtgtgatcctggtattgggtggttctacaaatgcggtaatgcacttaattgcaattgcaaaagctgcgggtgttaaattaacgatcgatgattttcaacgcatcggtaatacaacaccgttactggcagatttaaaaccaagcggcaagtatatgatggaagatatggacgctattggcggcgtaccttctgtaatgcgtttgttggcaaaacataatttacttcatttagattgtatgactgtaacaggtaaaactgttggagagaatttaaaagaagctcaggatcttcctacggatcaggatctgatgtatgcatgggaaaacccgatcaaacaaacaggtcacttacagattctgtatggcaatcttgcaccacaaggttctgtggcaaagattaccggtaaagaaggaacatactttgaaggtcctgcacgcgtgtacgactctgaagaggctgtaaacaaaggtttagaggctaatgaagtaaaatcaggtgaagtaattgtaatccgttatgttggtccgaaaggcggcccgggcatgcctgaaatgttgaagccaactgctctattaatgggcttaggtttaggcaacgaatgtgccttaatcacagacggacgtttctctggcggtacacatggtttcgtagttggccacattacaccggaagcaacagaagggggtatgattggccttgtaaaaaatggcgacatcatccgtattgatgcagtaaacagagtcctagaagttaaaatttccgaggaggaagtaaccaaacgccgtgcggcatgggtaaaacctgcgccaagagctacatccggcgtgttatataaatacatgaaattagtatcttctgcatctgagggatgcgttaccgataattaa

SEQ ID NO: 238 - protein, 562 aa, Cytophaga hutchinsonii
MIIVSTELNKISKRLTQDPSQPASQAMMYGAGFTDEDMKKPIVGIGSTGFDGNTCNMHLNILAGQVKGSITRGGMVGLGFNTIGVSDGISMGTEGMRFSLVSRDVIADSIETICEAHYYDALVTVVGCDKNMPGALIAMARLNRPSIMVYGGTIHSGHYKGEKLNIVSAFEALGKKVAGTITEEDYQGVIKNACPGAGACGGMYTANTMASAIEAMGLTLPYSSTAPATSEKKKAETLALGKAMMHLLEKDIKPRDIMTFEAFENAIRVILVLGGSTNAVMHLIAIAKAAGVKLTIDDFQRIGNTTPLLADLKPSGKYMMEDMDAIGGVPSVMRLLAKHNLLHLDCMTVTGKTVGENLKEAQDLPTDQDLMYAWENPIKQTGHLQILYGNLAPQGSVAKITGKEGTYFEGPARVYDSEEAVNKGLEANEVKSGEVIVIRYVGPKGGPGMPEMLKPTALLMGLGLGNECALITDGRFSGGTHGFVVGHITPEATEGGMIGLVKNGDIIRIDAVNRVLEVKISEEEVTKRRAAWVKPAPRATSGVLYKYMKLVSSASEGCVTDN

SEQ ID NO: 239 - DNA, 1764 bp, Rhodopirellula baltica
ttgaccctttcaaggtgttgccacccatcttcggccgctttcccctgccaaaacgatctcatgaccgcgtctcagcctgaatccgattccaatgcactgaacaagtacagcagcaagatcacccagccgaaaagccagggtgcgtcgcaggcgatgctttacgccaccggcatgtcctcggaggatatgaacaagcctcaagtcggcatcggcagcatgtggtacgagggcaacagctgcaacatgcacctgctcgatctcgcagcggatgttaaagctggagtcaccgacgccggaatggtcggaatgcgtttcaacaccatcggtgtctcggacggcatctcgatggggaccgacgggatgagcttctcactgcaaagtcgcgacctgatcgccgactcgatcgagacgatcatgggggcgcagtggtacgacgcgttgatcaccctgcccggctgcgacaagaacatgcccggctgtttgatggcgatgggacgtctgaaccgtccttccatcatggtctacggtggaacgattaaacctggcagctaccgcgacgagaagctggacatcgtcagcgcgttccagtgctacggccagttcatcgcgggacaaatcagcgaagaagaacgcagtgaaatcgttcgccgcagttgcccaggtgcgggagcatgcggcggcatgtacaccgccaacacgatggccaccgcaatcgaagccttgggcatggccctgccctactccgccagcatccctgcagagcatccagaaaagaaagaggaatgcaaacgtgccggtttggccatcctcgaactgttgaagaaggacatcaagcctcgcgacatcatgactcgcggtgcattcgaagacgcgatggtgacattgatggcactgggcggcagcaccaacgcggtgcttcacttgatcgcgatggctcgcagcgtcgatgtgccactgacgattgaagacttccaatcggtcagcgaccgcacacctttcttggccgacctgaaacccagcggcaagttcgttcaagaagacctgcacagcgtcggtggcacgcccgcggtgatgaagtacttgctcgaaaagggcatgatcaaaggcgagcacatgaccgtcaccggcaagactctcgcggagaacctggccgatttgcctggtttgaagaccggccaaaagatcgtgtcgacggtcgaagagccgatcaaaaaatcgggtcacattcgaatcctgaaaggatcactggccacggaaggcgcggtcgcgaaaatcactggcaaagaaggtctgcagttcagcggaccggctcgtgtctatgacaatgaggaattgatgctcgccgctttggaacaaaagcagattcaaaagggtgacgtcgttgtgatccgctacgaaggtcccaagggcggacccggcatgcctgagatgttgactccaaccagtgccatcatgggtgctggtttgggaagcgacgtcgcgatgctgactgacggccgtttcagcggcggtagtcacgggttcatcgtggggcacatcactcccgaagcacaagttggtggtccgatcgcattgatcgaagatggagacacgatcacgattgatgccgaaaccaactcgttggacttagaagtcgatgcggctgaattggaagcccgccgatccaagtggaccgcaccgccactgaaagccacccgcggaacgctctacaagtacatcaagtgcgtgaagagcgccagcgaaggctgcgtcaccgacgagtga

SEQ ID NO: 240 - protein, 587 aa, Rhodopirellula baltica
MTLSRCCHPSSAAFPCQNDLMTASQPESDSNALNKYSSKITQPKSQGASQAMLYATGMSSEDMNKPQVGIGSMWYEGNSCNMHLLDLAADVKAGVTDAGMVGMRFNTIGVSDGISMGTDGMSFSLQSRDLIADSIETIMGAQWYDALITLPGCDKNMPGCLMAMGRLNRPSIMVYGGTIKPGSYRDEKLDIVSAFQCYGQFIAGQISEEERSEIVRRSCPGAGACGGMYTANTMATAIEALGMALPYSASIPAEHPEKKEECKRAGLAILELLKKDIKPRDIMTRGAFEDAMVTLMALGGSTNAVLHLIAMARSVDVPLTIEDFQSVSDRTPFLADLKPSGKFVQEDLHSVGGTPAVMKYLLEKGMIKGEHMTVTGKTLAENLADLPGLKTGQKIVSTVEEPIKKSGHIRILKGSLATEGAVAKITGKEGLQFSGPARVYDNEELMLAALEQKQIQKGDVVVIRYEGPKGGPGMPEMLTPTSAIMGAGLGSDVAMLTDGRFSGGSHGFIVGHITPEAQVGGPIALIEDGDTITIDAETNSLDLEVDAAELEARRSKWTAPPLKATRGTLYKYIKCVKSASEGCVTDE

SEQ ID NO: 241 - DNA, 1683 bp, Blastopirellula marina
atgtccgccccgctcaacaagtacagcagccgcgttacccagccaaaaagccagggcgcgtcgcaggccatgctttacggaaccggcatgaccgacgccgacatggacaaagcgcaggttggcatcgccagcatttggtacgagggcaacacgtgcaacatgcacctgaatcagctctcggaagtggtgaaaaaaggggtggtaggcgccgacatggtcgggatgcggttcaacacgatcggcgtgagcgacggcatctcgatggggaccgaagggatgagcttctcgctccaatctcgcgacctgatcgccgactcgatcgaaacggtcatgggcggtcagtggtacgacggactgatcgcgctgccgggctgcgacaaaaacatgccgggatgtttgatcgcgatggggcgtttgaaccgtccgtcgatcatggtctacggcggtacgatcaaaccgggccacaccagcaagggagagaagctcgacatcgtctcggctttccagtgctacgggcaattcctctcggaaggaatcaccgaagaagaacgcaaagaaatcgtgcacaaagcttgtcctggagcgggcgcttgcggcggcatgtacaccgccaacacgatggcgacggcgatcgaagcgatgggcatgacgctgccttacagcagcagcattccggccgaagatccggcgaagcagcaagaatgcatcgacgccggcaaagcgatgcgctacttgctggagaaagatattaagccgcgcgacatcatgacccgtgatgcgtttgaaaacgcgatggtcacggtgatggcgctcggcggttcgaccaacgccgtgttgcacttgatcgcgatggctcgcgcggtggatgtcgacctgtcgatcgacgacttccaaacggtcagcgatcgcgtccctttcttggccgatctgaagccgagcggcaagtttgtgcaagaagatctgcactcgatcggcggtacgccggccgtcctgaagtatctgctggccgaaggcttcttgaagggggactgtatgacggtgaccggcaagacgctggccgaaaacatcgccgatcttcccggcttgaaagaaggccagaagatcgtccacccactgtcggacccgatcaagtcctccggtcacatccagatcttgaagggcacgctggcccccgaaggcgccgtcgccaagatcaccggcaaagaaggactccgctttcaagggccggccaatgtctttgatagcgaagaagacatgttgcacgcgctggaagacaagaagatcaaaaagggagacgtcgtcattattcgctacgaaggtcccaagggaggccccggcatgccggagatgctgactccgacctcggcgattatgggggccggtctcggcagcgatgtcgcactgctgaccgatggccgcttctccggcggctcgcacggtttcatcgttgggcatatcacgcctgaggcgcaagacggaggcccggtcgcgctcgttcaaaatggcgacatcgtcacgatcgacgccgacaccaactcgattgacgtcgacgtgccggccgatgagatggcgaaacgcttggccgcttggaaggctccggcctacaaagcgacccgcggcacgctttacaagtacatcaagaatgtgaaaagcgcttcagaaggttgcgtgaccgacgaataa

SEQ ID NO: 242 - protein, 560 aa, Blastopirellula marina
MSAPLNKYSSRVTQPKSQGASQAMLYGTGMTDADMDKAQVGIASIWYEGNTCNMHLNQLSEVVKKGVVGADMVGMRFNTIGVSDGISMGTEGMSFSLQSRDLIADSIETVMGGQWYDGLIALPGCDKNMPGCLIAMGRLNRPSIMVYGGTIKPGHTSKGEKLDIVSAFQCYGQFLSEGITEEERKEIVHKACPGAGACGGMYTANTMATAIEAMGMTLPYSSSIPAEDPAKQQECIDAGKAMRYLLEKDIKPRDIMTRDAFENAMVTVMALGGSTNAVLHLIAMARAVDVDLSIDDFQTVSDRVPFLADLKPSGKFVQEDLHSIGGTPAVLKYLLAEGFLKGDCMTVTGKTLAENIADLPGLKEGQKIVHPLSDPIKSSGHIQILKGTLAPEGAVAKITGKEGLRFQGPANVFDSEEDMLHALEDKKIKKGDVVIIRYEGPKGGPGMPEMLTPTSAIMGAGLGSDVALLTDGRFSGGSHGFIVGHITPEAQDGGPVALVQNGDIVTIDADTNSIDVDVPADEMAKRLAAWKAPAYKATRGTLYKYIKNVKSASEGCVTDE

SEQ ID NO: 243 - DNA, 1692 bp, Planctomyces maris
atgtcagccgattcgcaacccgttttgaacaagtacagttcccgtatcacacagccccgttcgcagggtgcctcgcaagccatgctctacgccaccggcatgagcgaagaggatatgaacaaggcccaggtcggaatttccagcgtctggtacgaaggcaattcctgcaacatgcacctcaacaaactggctgccaaggtcaaagagggcgtcgaagccgccgatctggttggcctgcggtttaataccatcggtgtgagcgacgggatttccatgggcaccgacggcatgtcctattcgctgcagtcccgcgacctgatcgccgacagtatcgaaacagtcacctgtgcccagtggtacgatgccaacatttcgctgcctggctgtgataagaacatgcctggctgcctgattgccatgggacgatttaaccgcccctcgatcatggtttacgggggaacgattgctcccggctgtctgaataatcagaagctggacattgtctccgcatttcagtcttacggcgaatacctggctggtacgatcacagatgaaacccgaaaagaaatcgtacagaaaagctgtccgggcgctggtgcctgcggcggcatgtataccgccaacacgatgtcgtctgccatcgaagctctggggatgtcactcccttacagttcttccattcctgcagagcatcccgataaactcgatgagtgtatccgcgctggtgccgccatcaggaaactgctggaactggatctgaaaccccgcgacatcatgacccgcgaggctttcgaaaatgcgatggtactgattgtcgcactggggggatcgaccaacgccgtgctgcacatgctggccatcgcccgttctgtcggcctggaactgactattgatgacttccagtccgtcagcgatcgtattcctttgctggccgatttcaaacccagtggtaaatacgtgatggctgacctgcaggagattggcgggacaccagccgtgatgaaatacctgctggaaaaaggcctgatcaacggcgactgcatgacggtcacgggaaaaacagtggccgaaaacctggcagaactaccgggcctcaaagagggtcaggatatcattcacgctgtcgaaaacccgatcaagccgaccggtcacctgcagatacttaaaggcaacctggctccgacaggtgccgtcgccaagatcaccggtaaggaaggcctggtcttcgaagggaccgccaacgtcttcgattccgaagaggacatgctcaaagccctcgaagacaagcagattcaaaaaggcgatgtgatcatcatccgctacgaaggccccaaagggggaccagggatgcccgaaatgctgaccccgacttccgccatcatgggagccggcctgggtaaggatgttgccctgctgaccgacggtcgtttttctggtggttcacacggctttatcgtcggacatatcactcctgaagcacaggaaggcggtccaatcgccctggtcaaaaatggcgacaaggtcattatcgacgccgacaaaaatcgactggagatggatgtcagtgatgcagagctcgaagaacgtcgcaaagcctggacggcccctccgtttaaatacacgcggggtacactttacaaatatatcaagaatgtgaaatccgcttctgaaggttgtgtgaccgacgagtaa

SEQ ID NO: 244 - protein, 563 aa, Planctomyces maris
MSADSQPVLNKYSSRITQPRSQGASQAMLYATGMSEEDMNKAQVGISSVWYEGNSCNMHLNKLAAKVKEGVEAADLVGLRFNTIGVSDGISMGTDGMSYSLQSRDLIADSIETVTCAQWYDANISLPGCDKNMPGCLIAMGRFNRPSIMVYGGTIAPGCLNNQKLDIVSAFQSYGEYLAGTITDETRKEIVQKSCPGAGACGGMYTANTMSSAIEALGMSLPYSSSIPAEHPDKLDECIRAGAAIRKLLELDLKPRDIMTREAFENAMVLIVALGGSTNAVLHMLAIARSVGLELTIDDFQSVSDRIPLLADFKPSGKYVMADLQEIGGTPAVMKYLLEKGLINGDCMTVTGKTVAENLAELPGLKEGQDIIHAVENPIKPTGHLQILKGNLAPTGAVAKITGKEGLVFEGTANVFDSEEDMLKALEDKQIQKGDVIIIRYEGPKGGPGMPEMLTPTSAIMGAGLGKDVALLTDGRFSGGSHGFIVGHITPEAQEGGPIALVKNGDKVIIDADKNRLEMDVSDAELEERRKAWTAPPFKYTRGTLYKYIKNVKSASEGCVTDE

SEQ ID NO: 245 - DNA, 1680 bp, Algoriphagus sp.
atgaccctgaaaaaacacagttgggaaatcagcgacaattcggagcatccggctgggatggctatgttgtatgccaccggaatgagcgataaaaagatgaaacagccatttgtagggatagcgagttgcggctatgaaagtaatccctgcaatatgcatttgaacgactttgccggtctgatcaaagcttcttcacaagagcaagatctgaccggtttagtttttaataccattggtatttctgacggaaccacgatgggaaccttggggatgcgttattcactggtttctagggagataattgctgattctatagagtcttttatcatagggcattcatttgatgcttgtatttctgttgcaggatgtgacaagaatatgcctggtgcattgatggggatgatccgtactaacagaccttctattttggtgtatggaggaacgatagcctctggacattataagggagaaaagctaaatatcgtttcggcatttgaagcctttggaaagcgagtgaatggaaacatttctgatgaagattatgatggtgtcatcagaaacgcatgtccaggaaaaggagcttgtggaggtatgtatactgccaataccatgtcttcagcaattgaagcgatgggaatgtcattgccttactcctcttcttatccggcaaactctccagaaaaattgagggagtgtggagaagtgaataaatatatgagaatccttttagaaaaggatttgaaacctagtgatatcatcactagaaaaagtattgaaaatgcagtaaccgtagcaattgccttaggtggtagtaccaatgcggtaatgcatatcattgcgatcgcccgaactgccggtgtagattttaccattgaggattttaaagcaatcaatgcaaaaactccaatgattggtgatttcaaaccttctggaaaattcatgatggaagaccttcacgaacaaggtggacttcctgcctttatgaagtatatgttgcagaatgggttcattcatggagattgcttaactgtgactggaaagacggttgcagaaaaccttgagaatattgaacctgtgactccatcgatggtgaatgttattcatcctttggaaacgccgataaaagcaacgggtcatttatgtgtgctttcaggaaatcttgctccagaaggagcggttgccaaaattacaggtaaagaaggaagttcttttacaggacctgcacatgtttttgactcagagcaggatgccaatgatgctatcagagatcataaaattgagaagggtgaagttattgtcattcgaaatatcggacccaaaggtggtccaggaatgcctgaaatgttgaagcctacttctatgattataggagctggtttaggatcagacgttgccttaattactgatggaagattttccggaggaacacacggatttgtggtagggcacgttacaccagaagcgtttagcggaggacctatcggattggtcagaaatggagatatcatcacgatagatgctgataacttacagctgagcgttgcgatttctgaagaggagtttgaagaaagaaagaaaacttggaaacgaaaagaaatttctgatttgcaagggactttgaaaaaatacaataaacttgttgccactgcatctgaaggttgcgtgacagataaattctaa

SEQ ID NO: 246 - protein, 559 aa, Algoriphagus sp.
MTLKKHSWEISDNSEHPAGMAMLYATGMSDKKMKQPFVGIASCGYESNPCNMHLNDFAGLIKASSQEQDLTGLVFNTIGISDGTTMGTLGMRYSLVSREIIADSIESFIIGHSFDACISVAGCDKNMPGALMGMIRTNRPSILVYGGTIASGHYKGEKLNIVSAFEAFGKRVNGNISDEDYDGVIRNACPGKGACGGMYTANTMSSAIEAMGMSLPYSSSYPANSPEKLRECGEVNKYMRILLEKDLKPSDIITRKSIENAVTVAIALGGSTNAVMHIIAIARTAGVDFTIEDFKAINAKTPMIGDFKPSGKFMMEDLHEQGGLPAFMKYMLQNGFIHGDCLTVTGKTVAENLENIEPVTPSMVNVIHPLETPIKATGHLCVLSGNLAPEGAVAKITGKEGSSFTGPAHVFDSEQDANDAIRDHKIEKGEVIVIRNIGPKGGPGMPEMLKPTSMIIGAGLGSDVALITDGRFSGGTHGFVVGHVTPEAFSGGPIGLVRNGDIITIDADNLQLSVAISEEEFEERKKTWKRKEISDLQGTLKKYNKLVATASEGCVTDKF

SEQ ID NO: 247 - DNA, 1677 bp, Candidatus Sulcia muelleri
atggcgattaatacatttagtattaaattaactaaaaatagtactttacctgctgcacaagcaatgctgtatgctactgggttaaaagaatatgattttaatcaagctcaagttggcatagttagtaattggtatgaaggtaatccatgtaatattcatttacatattattagtaataatataaaatcatctataaaaaaaaatggaatggtggggtttaaatttaatactataggtattagtgatggtatgtctatgggaacatctggaatgagatattctttaccatcaagagaattaatagctgatagtatagaaagtgttgttaaaactcaacattatgatggattaataggaattccaggatgtgataaaaatatccctggaatagttatggcaatgttacgtattaatagaccttctatattagtatatggaggtagtatatcatcaggatattataatggtaaaaaattaaatatagtttctgcttttgaagctttaggagaaaaaaatataggtaaaatttcagaattagaatataaaaatataattaaacatgcttgtcctggtccaggagcttgtggaggaatgtatacagctaatacaatggcttcttgtcttgaagcaatgggaataacaattccatattcatcttcatcattagctaatagtagctttaaaaaaaaagaatgtattaatataggttattatataaataatatattaaaaaataatattaaaccattggatattattacttataaatctataaaaaatgctataactctagcaatagcattaggaggatcaacaaatttagtaatacatattttagcaatagctaaaactgctaatttagatctaaaattagatgatattcaaaatatcaataataatgttccaattatagctaatttaaaaccaagtggagattttttaatggaagatatacaatctatgggaggaattcctataattataaaatatttattaaaagaaggatatatagaaggagactgtattactgtaacaggaaacacaataaaaaaaaatttagaaaatatacctgatctttcttttaaagaaaaaattatatatcctttattaaatcctataaaaaaaaatgggcatatacgtattttatatggtaatatagccccttatggagctgttgctaaaattactggaaaagaaggtgatattttttcaggatttgcacaagtttttaattcagaaaactctgctaataaagcaataattaataataaaattaaagaaggagatgtaatagtaattagatatgtaggtcccagaggaggtcctggaatgcctgaaatgcttaaacctacttcttacataatgggggctaatttaagtaaaaaaattgctttaataactgatgggagattttcaggaggatctcatggatttgtagtaggtcatattactccagaggctcaaaatggaggattaattgctttaatagaaaatggagatattataataattgatgcaataaagaatactataacattaaaaatatcaaaaaaagaaataaaaaatagaaaaaaaacacccttgcgagtgcgaggtaaagtaaattcaggttatttatataagtatacaaaaactgtatcatctgcttataatggatgtgtaacagataaattgtaa

SEQ ID NO: 248 - protein, 558 aa, Candidatus Sulcia muelleri
MAINTFSIKLTKNSTLPAAQAMLYATGLKEYDFNQAQVGIVSNWYEGNPCNIHLHIISNNIKSSIKKNGMVGFKFNTIGISDGMSMGTSGMRYSLPSRELIADSIESVVKTQHYDGLIGIPGCDKNIPGIVMAMLRINRPSILVYGGSISSGYYNGKKLNIVSAFEALGEKNIGKISELEYKNIIKHACPGPGACGGMYTANTMASCLEAMGITIPYSSSSLANSSFKKKECINIGYYINNILKNNIKPLDIITYKSIKNAITLAIALGGSTNLVIHILAIAKTANLDLKLDDIQNINNNVPIIANLKPSGDFLMEDIQSMGGIPIIIKYLLKEGYIEGDCITVTGNTIKKNLENIPDLSFKEKIIYPLLNPIKKNGHIRILYGNIAPYGAVAKITGKEGDIFSGFAQVFNSENSANKAIINNKIKEGDVIVIRYVGPRGGPGMPEMLKPTSYIMGANLSKKIALITDGRFSGGSHGFVVGHITPEAQNGGLIALIENGDIIIIDAIKNTITLKISKKEIKNRKKTPLRVRGKVNSGYLYKYTKTVSSAYNGCVTDKL

SEQ ID NO: 249 - DNA, 1650 bp, Candidatus Carsonella
atgaaatcaaaattaataacaaaatggccaataaaagcagcaaatagagccatgttgcgtgcagttggatataacgattatgattttaataaatttcaagttggaattgcatcaacttggagtaatataacaccttgtaataatcatatcaatgtattagctaaagcagttgaatatggagtaaattcaaaattttgtaaaggaacaatatttaatacaataacagtatctgatggaatatcaaatggtaattttggaatgaaatattcattactatcaagagatataatttcaaattcaatagaagttgttggcaaagcacaaaattttgatggtattatttctattggaggatgtgacaaaaatattcctggttgtattattggaatgtgtaatttagaaattccttcaatttttatatatggtggtacaattttaccaggcaaaaatagaacagatattgtctctgtttttgaatctttgggtaaattttataataaaactattaatgaaaaagaattgttaaatattgaaaaaaactccattattggatctggatcatgtagtggaatgtatacagcaaattcaatggcaattgttgcagaatgcctaggaattagcttaccaaactcttctattcaaaatgcgcaatcaattaataaaattgttaattgtattaattctggtaaattaataaaaatattgttagaaaataatattacaataaaaaaaattattaataaagaatctattttaaattctataaaagtaatttcattattaggtggatcaacaaattgtttaattcatttattagcaattgctaattgtttaaaaataaatttatctttaaaagatttacaatttgaaactaataacttaccaacgttatctgatttaaaaccaagtggaaaattttttatttcagatttaattaatactggtggaatacaaaaatttttaaaatatttaattgatattaatttaataaatggtaatttattaacggttacaggtaattcattaaaagaaaatttaaaatttattaaaataaattataaaaataaaatactaaaagatatcaataatcctgttaaaaaaactaatcaaatcaaaatattatttggaaacttatcaataaatggttgtatatcaaaaatatcgggtaaagaaggagaaatattctttggaaaagcactagtatttaattcagaagaagaatctgttaattatatttataaaaaaaaaattcaaaataacacaattataattataaggtatgaaggtccaaaaggaggccctggaatgagagaaatgttaactcctacttctgctttaataggagttggaaagaaaaattctgttgctttaataacagatggtagattttcaggtggaagccacggatttgttgtaggacatatttcgccagaagcatatgattttggtacaatttgtttaattaataataatgatctaataataatagatactataaacaattttattagtttatttttaaacaaaagaagcttaaaaagtagattttataaagttaaaatatttaacaaaatagtttcaggtattttaaatttatataaaaaatattcgatttgctcatcgaaaggtgcattattaaattatgaataa

SEQ ID NO: 250 - protein, 549 aa, Candidatus Carsonella
MKSKLITKWPIKAANRAMLRAVGYNDYDFNKFQVGIASTWSNITPCNNHINVLAKAVEYGVNSKFCKGTIFNTITVSDGISNGNFGMKYSLLSRDIISNSIEVVGKAQNFDGIISIGGCDKNIPGCIIGMCNLEIPSIFIYGGTILPGKNRTDIVSVFESLGKFYNKTINEKELLNIEKNSIIGSGSCSGMYTANSMAIVAECLGISLPNSSIQNAQSINKIVNCINSGKLIKILLENNITIKKIINKESILNSIKVISLLGGSTNCLIHLLAIANCLKINLSLKDLQFETNNLPTLSDLKPSGKFFISDLINTGGIQKFLKYLIDINLINGNLLTVTGNSLKENLKFIKINYKNKILKDINNPVKKTNQIKILFGNLSINGCISKISGKEGEIFFGKALVFNSEEESVNYIYKKKIQNNTIIIIRYEGPKGGPGMREMLTPTSALIGVGKKNSVALITDGRFSGGSHGFVVGHISPEAYDFGTICLINNNDLIIIDTINNFISLFLNKRSLKSRFYKVKIFNKIVSGILNLYKKYSICSSKGALLNYE

SEQ ID NO: 251 - DNA, 1674 bp, Synechococcus sp.
atgctccgctccgacgccgtcacgcagggaatctcccgctcccccaaccgcgccatgttgcgtgcggtcggttttggtgacgccgacttcggcaagccgatcatcggcatcgccaacggctacagcaccatcaccccctgcaatgtggggctgaacgatctggcgatgcgagctgaagcgtcagcgcgtcaggccggcggcatgccccaaaccttcggaaccatcaccgtcagcgatggcatttcgatgggcacggaaggaatgaagtactccctggtgagcagggaagtgatcgctgacgcgatcgaaacggcctgcaatggccagagcatggatggggtgctcgctgtcggtggctgcgacaaaaacatgcccggcgccatgctcgcgatggcccgcatgaacatcccgtccatttttgtctatggcggcaccatcaaacccggcaaactcggcggctgtgatctcaccgtggtgagtgcctttgaggccgtaggtcagatcaccagcggcaagattgacgaagaacagctaacggcgattgaaaagaatgcctgccccggtgcaggcagctgtggcggcatgttcaccgccaacaccatgagtgctgcgatcgaaaccctcggtctgagcctgccctacagctccaccatggcggcggaagactccgagaaggctgatagcgcagcccgttcagccgaggtgcttgttgatgccatcaaagccaacattcgcccgcttgatctactcaccaaggaagcgtttgaaaacgccatcagcgtgattatggccgtgggtggctccaccaattcagtgctccacctgctcgccattgcccgcactgccggcgtcgatctgagcatcgacgattttgagcgcatccgtcagcgggtcccggtgatctgtgacctcaaacccagtggccgttttgtcacggttgatcttcatcaggctgggggcattcctcaggtgatgaaattgcttctggatggaggactactccatggcgagtgccgcaccatcgaaggcaaaagcctgaaggaactgttggctgatgtgccttcggttccgcctgctgatcaggaggtcattcgcccactgtccaatcccttgtacgccaaggggcacctggccatcctcaaaggcaacctcgcctcagaaggtgccgtcgcaaagatcagcggtgtgaaaaatccggtgatcaccggtccggcacgggtgttcgaaagcgaagaaacctgccttgccgccatcctcgacaaccaggtcaaggccggtgatgtggtggtcgttcgcaacgaaggcccggtgggtggtcccggcatgcgggaaatgctcagccccacatccgcaattgtgggacagggcctgctcgacaaagtggccctgattaccgacggacgtttctccggtggttcctacggcttggtgatcggccacgtggcgccagaagccgccgtcggtggcaccatcggcctagtgcatgaaggcgacagcatcactgtcgacgccaacaaactgctgattcaactgaacatcgacgaagccgaactggaacgccgccgtaacgcctgggcgcctgcgaccccgaagtaccgcacagggatcctgggcaaatatgcgcgcctggtctcaagttccagccgcggcgccaccaccgacatcgcggactaa

SEQ ID NO: 252 - protein, 557 aa, Synechococcus sp.
MLRSDAVTQGISRSPNRAMLRAVGFGDADFGKPIIGIANGYSTITPCNVGLNDLAMRAEASARQAGGMPQTFGTITVSDGISMGTEGMKYSLVSREVIADAIETACNGQSMDGVLAVGGCDKNMPGAMLAMARMNIPSIFVYGGTIKPGKLGGCDLTVVSAFEAVGQITSGKIDEEQLTAIEKNACPGAGSCGGMFTANTMSAAIETLGLSLPYSSTMAAEDSEKADSAARSAEVLVDAIKANIRPLDLLTKEAFENAISVIMAVGGSTNSVLHLLAIARTAGVDLSIDDFERIRQRVPVICDLKPSGRFVTVDLHQAGGIPQVMKLLLDGGLLHGECRTIEGKSLKELLADVPSVPPADQEVIRPLSNPLYAKGHLAILKGNLASEGAVAKISGVKNPVITGPARVFESEETCLAAILDNQVKAGDVVVVRNEGPVGGPGMREMLSPTSAIVGQGLLDKVALITDGRFSGGSYGLVIGHVAPEAAVGGTIGLVHEGDSITVDANKLLIQLNIDEAELERRRNAWAPATPKYRTGILGKYARLVSSSSRGATTDIAD

SEQ ID NO: 253 - DNA, 1671 bp, Synechococcus sp.
atgctccgctccgatgccgttaccaaggggattcagcgctcacccaatcgggcgatgctgcgagccgtcggtttcggcgatcaggacttcggaaaaccaatcattggcatcgccaacggctacagcacgatcacgccctgcaacgttgggctcgatgatctcgccaggcgtgccgaagaggcggcccgcctagcgggaggtatgcctcaaacgttcgggaccatcaccgtcagcgacgggatctcgatgggaacagagggaatgaaatattccctggtgagccgggaagtgatcgccgacgccatcgaaacagcctgcaatggccagagcatggacggcgtgttggccgtgggcggctgcgacaagaacatgcctggagccatgctcgcgatggcgaggatgaacatcccggcgatcttcgtgtacggcggcaccatcaagcccggaaaactcggcggctgcgacctcaccgtggtcagtgcttttgaagcggtcggtcagatcaccagcggcaagatcgacgaggagcagctcacggccatcgagaaaaatgcctgccccggggctggcagctgcggcggcatgttcaccgccaacaccatgagcgccgccatcgaaacgatgggactcagccttccgcacagctccaccatggctgctgaagatgaagagaaggccgagagcgcagcccgatcggcggaggtgttggtgcaggccatcgaatccggcatccgccccctcgacctgatgacccgtgaggccttcgaaaatgccatcagcgtgatcatggcggtgggtggttccaccaattccgtgctgcatttgctcgccattgcccgcactgctggggtggagctcgccatcgacgactttgaacggatccgccagcgcgttccagtgatctgcgacctcaaacccagtggccgttacgtcacggtggacctccaccgcgccggtggaattccccaggtgatgaaactgctgctggatgccggactcctccacggtgattgccgcaccatcgaaggcaaaaccctgaaggagctgcttgccgatgtgccctccactccgcccgcggatcaggatgtgattcggccgctctccaatcccctttatgccaagggccacctggccatccttaagggcaatctggcttccgaaggagctgtcgcgaagatcagtggtgtgaagaatccggtgatcaccggtccagcaagggtgtttgagagcgaagaaagctgtcttgaagcgattctcgacaatcagatcaaggccggtgatgtggtggtggtgcgcaatgaaggcccggtcggcggaccgggcatgcgcgagatgctcagtcccacgtccgcgatcgtgggacaagggctactcgacaaggtggcgctgatcaccgacggacgcttttcaggtggctcctatggcctcgtgattggccatgtagcccccgaagcggccgtgggcggaaccatcggtttgatcgaggaaggagacagcatcaccgtggacgccaatcagctgctgctgcaactgaatgtggaggaggctgagctggagcggaggcggagtgcatggtcggcaccagtgccgaagtaccgcacggggatcctcggcaaatatgcccggcttgtgagttccagcagccagggtgcggtcaccgaccagccctga

SEQ ID NO: 254 - protein, 556 aa, Synechococcus sp.
MLRSDAVTKGIQRSPNRAMLRAVGFGDQDFGKPIIGIANGYSTITPCNVGLDDLARRAEEAARLAGGMPQTFGTITVSDGISMGTEGMKYSLVSREVIADAIETACNGQSMDGVLAVGGCDKNMPGAMLAMARMNIPAIFVYGGTIKPGKLGGCDLTVVSAFEAVGQITSGKIDEEQLTAIEKNACPGAGSCGGMFTANTMSAAIETMGLSLPHSSTMAAEDEEKAESAARSAEVLVQAIESGIRPLDLMTREAFENAISVIMAVGGSTNSVLHLLAIARTAGVELAIDDFERIRQRVPVICDLKPSGRYVTVDLHRAGGIPQVMKLLLDAGLLHGDCRTIEGKTLKELLADVPSTPPADQDVIRPLSNPLYAKGHLAILKGNLASEGAVAKISGVKNPVITGPARVFESEESCLEAILDNQIKAGDVVVVRNEGPVGGPGMREMLSPTSAIVGQGLLDKVALITDGRFSGGSYGLVIGHVAPEAAVGGTIGLIEEGDSITVDANQLLLQLNVEEAELERRRSAWSAPVPKYRTGILGKYARLVSSSSQGAVTDQP

SEQ ID NO: 255 - DNA, 1674 bp, Synechococcus sp.
atgcttcgctcagacgccgtcactcaaggcattcagcgctcacccaatcgagcaatgctgagagcggttggcttcggtgatgaagatttcggcaagcccattatcgggatcgctaacggttacagcacgattacaccttgcaatgtgggattgaatggtctgtcccgtcgtgccgaagattcggctcgaaaggcaggtggaatgcctcagactttcggaaccatcaccgtcagcgatggcatctcgatgggcacggaaggaatgaaatattccttggtgagccgtgaagtgattgctgatgcaattgaaacggcctgcaatgggcaaagtatggatggcgttctggcggttggtggttgcgataaaaatatgcctggcgccatgttggcgatggcacgtatgaatatcccctcgatttttgtgtacgggggaacaattaagccgggaaaattaggtggctgtgacctcactgttgtgagtgcttttgaggctgtcggtcagattacgagtgggaaaattgatgaagagcagctaactgcgattgaaaaaaatgcctgcccaggtgctggcagctgtggaggcatgttcacggccaatacgatgagtgctgcgattgaaacgatggggctgagtcttccccacagttcaacgatggctgccgaagatgaggaaaaagcagagagtgcggctcgttctggtgaagtcctcgttgaggcaattaaatccaatattcgcccccttgatttgctcacgcgggaagcctttgaaaatgccatcagcgtgatcatggcggtgggcggctccaccaactctgtgttgcatttgcttgctatcgcgcgcacagcaggcgtggatctcagcatcgacgactttgaacagatccgccaacgcgttccggtgatttgtgatctaaaaccgagtggtcgttttgtcaccgtggatcttcatcaggctgggggcattccacaggtgatgaaattgcttttagatgcgggcttgctccatggcgattgccgcacgattgaagggaaaacattgaaagaattgttggctgatattccttcaacgcctcctgaaggacaagaagtgattaggccgttaagtaaccccctttatgccaaagggcatttggccattctgaaaggaaatttggcaagcgaaggagctgtcgccaaaatcagcggcatcaaaacgcctgtcctcacaggtcctgctcgcgtttttgaaagcgaagaggattgtttagcgtcgattattggtaaacatattcatgctggtgatgtcatcgtgattcgccaggaaggtccagtgggaggtcctggaatgcgcgaaatgcttgcaccaactgctgccattgttgggcagggactcggtgacaaggtggcgctgattacggatggtcgattcagtggtggaacctatggtttggtggttggccacgtggctccagaagctgccgttggtggagcaatcggccttgttatggaaggagacagcatcactgtggatgccaatcaaaaccttcttcaactcaatgtgaatgaggctgaactcgaaacacgccgccgcacttggtcaggacataagcctagatacaagactggaattcttggcaaatatgctcgacttgtctcgagttctagtcgtggtgccgtgacagatcagcctgattaa

SEQ ID NO: 256 - protein, 557 aa, Synechococcus sp.
MLRSDAVTQGIQRSPNRAMLRAVGFGDEDFGKPIIGIANGYSTITPCNVGLNGLSRRAEDSARKAGGMPQTFGTITVSDGISMGTEGMKYSLVSREVIADAIETACNGQSMDGVLAVGGCDKNMPGAMLAMARMNIPSIFVYGGTIKPGKLGGCDLTVVSAFEAVGQITSGKIDEEQLTAIEKNACPGAGSCGGMFTANTMSAAIETMGLSLPHSSTMAAEDEEKAESAARSGEVLVEAIKSNIRPLDLLTREAFENAISVIMAVGGSTNSVLHLLAIARTAGVDLSIDDFEQIRQRVPVICDLKPSGRFVTVDLHQAGGIPQVMKLLLDAGLLHGDCRTIEGKTLKELLADIPSTPPEGQEVIRPLSNPLYAKGHLAILKGNLASEGAVAKISGIKTPVLTGPARVFESEEDCLASIIGKHIHAGDVIVIRQEGPVGGPGMREMLAPTAAIVGQGLGDKVALITDGRFSGGTYGLVVGHVAPEAAVGGAIGLVMEGDSITVDANQNLLQLNVNEAELETRRRTWSGHKPRYKTGILGKYARLVSSSSRGAVTDQPD

SEQ ID NO: 257 - DNA, 1674 bp, Synechococcus sp.
atgcttcgctccgacgccgtcaccaaggggatccagcggtctcccaaccgcgccatgttgcgggccgtgggctttggagacagtgatttcggcaagcccatcctgggcattgccaacggctacagcactatcaccccctgcaatatcgggctgaacgacctggccaaacgggctgaggaagcagcccgccaggccggaggcatgccccagatgtttggaaccatcaccgtgagtgatggaatctccatgggcactgaagggatgaagtactccctggtgagccgtgaagtgattgctgacgccatcgaaacggcctgcaacggtcagagcatggatggggtgctggccgttggtggctgcgacaagaacatgcctggcgccatgctggccatggctcggatgaacattccttcggttttcgtctacggcggcacgatcaagccgggcaagctcgggggctgtgatctcacggtggtgagcgcttttgaggcggtggggcaactcaccagcggcaagatcgacgaagtgcagctcaccgcagttgagaaaaatgcctgccctggggctggcagttgcggcggcatgttcaccgccaacaccatgagtgccgccatcgaaacgatggggctgagccttccctacagctccacgatggcagccgaggacgaggaaaaggccgacagtgccgctcgctccgctgaggtgctggtggaggcagtgaaagccaacattcgccctctggacctgctcaccaaggaagcctttgagaacgccattagcgtgatcatggcggtgggtggctccaccaatgcggtactgcacctgctggccattgcccgtaccgccggcgtcgacctgagcatcgatgacttcgaacggatccgtcagcgggtgccggtgatctgtgatctcaagcccagcggccgctacgtgaccgttgatctgcacaacgccggcggcattccccaggtgatgaagctgctgctggatgctggcttgctgcacagcgactgccgaaccgtggaaggcaaaagcctgaaggagttgctggccgatgtgccgtcggagccccccgccgggcaggaggtgatccgccccctcagcaatccgctgtacgccaaaggtcacctcgccatccttaagggcaacctcgccagcgagggaagcgtggccaagatcagcggcgtgaaaacccctgtgctcactggccctgcgcgggtgtttgaaagcgaggaagactgccttgccgccatcctcgataaaaagatccaggccggggatgtggtggtggtccgcaacgagggtcccgttggtggaccgggcatgcgggaaatgctggctccaacttcagcgattgttggtcagggcctgggggacaaggtcgccctgatcaccgatggccgctttagcggcggcacctatggcctggtggtgggtcatgtggctcctgaagctgctgttggtggaacgatcggcctggtgcaagaaggcgacagcatcacggttgatgctgatcagctgctgctccaactcaacgtggatcaagcggaactggatcgccgtcgtgcgggatggagcaagccggaaccgcgttaccgcagcggaattctcggcaagtacgcgcggctcgtctccagctcaagccggggtgcaaccaccgaccacgccgactga

SEQ ID NO: 258 - protein, 557 aa, Synechococcus sp.
MLRSDAVTKGIQRSPNRAMLRAVGFGDSDFGKPILGIANGYSTITPCNIGLNDLAKRAEEAARQAGGMPQMFGTITVSDGISMGTEGMKYSLVSREVIADAIETACNGQSMDGVLAVGGCDKNMPGAMLAMARMNIPSVFVYGGTIKPGKLGGCDLTVVSAFEAVGQLTSGKIDEVQLTAVEKNACPGAGSCGGMFTANTMSAAIETMGLSLPYSSTMAAEDEEKADSAARSAEVLVEAVKANIRPLDLLTKEAFENAISVIMAVGGSTNAVLHLLAIARTAGVDLSIDDFERIRQRVPVICDLKPSGRYVTVDLHNAGGIPQVMKLLLDAGLLHSDCRTVEGKSLKELLADVPSEPPAGQEVIRPLSNPLYAKGHLAILKGNLASEGSVAKISGVKTPVLTGPARVFESEEDCLAAILDKKIQAGDVVVVRNEGPVGGPGMREMLAPTSAIVGQGLGDKVALITDGRFSGGTYGLVVGHVAPEAAVGGTIGLVQEGDSITVDADQLLLQLNVDQAELDRRRAGWSKPEPRYRSGILGKYARLVSSSSRGATTDHAD

SEQ ID NO: 259 - DNA, 1674 bp, Synechococcus sp.
atgcttcgttccgacgccgtcacaaaggggatccagcgttcccccaaccgcgccatgctccgtgcggtgggattcggagatgaggacttcggcaagccgattctcgggatcgccaacggctacagcacgatcacaccctgcaatgtcgggttgaacgacctgtcccggcgcgctgaagaggctgcccgtcaggccggcggcatgccacagatgttcggaaccatcacggtgagtgatggcatctccatgggcaccgaagggatgaagtactccctggtaagccgtgaggtgatcgccgatgcgattgaaaccgcctgcaatggccagagcatggatggcgtgctggcggtgggcggctgcgacaagaacatgcccggcgccatgttggccatggcgcggatgaacattccggctgtgttcgtttacggcggcacgatcaagccggggaaactcggcggctgtgatctcaccgtggtcagcgcctttgaggcagttggtcagctcaccagcggcaacatcgacgaagaccagctcaccgctgtcgaaaagaacgcttgcccaggagccggcagctgcggcggcatgttcaccgccaacacgatgagtgcagccatcgaaacgatggggttgagcctgccctacagctcaacgatggcggcagaagacgaagagaaggccgacaatgccgctcgttcagcagaggtgttgttggacgcggtgaaggccaacattcgacccttggatctgctcaccaacgatgcattcgagaacgccatcagcgtgatcatggcggtgggtggatccaccaacgccgtgctgcacctgctggcgatcgcccgtacggctggggtctccctcagcatcgacgacttcgagcggatccgtcagcgcgtgccggtgatctgtgacctcaagccgagcggccgctacgtgacggtggatctccacaacgctggcggtatcccccaggtgatgagactgctgctcgatgccgggctgctgcatggcgattgccgcaccgttgagggcaaaagcctgcgtgaggtgctggcggatgtgccctccgtgccaccggccgatcaagacgtgatccgtccactgagcaatcccctttacggcaaaggccacctggccatcctcaagggcaacctggccagtgagggcagtgtggccaagatcagcggcgtcaagacaccagtgctcaccggccccgcccgggtatttgagagcgaggaagactgcctcgccgccatcctggatcaacggatcaaggccggcgatgtggtggtggtgcgcaatgaggggcccgtgggaggtccgggcatgcgcgaaatgctggcccctacctccgccatcgtcgggcaaggcctgggagacagggtggctctgatcaccgatggccgcttcagcggcggcacctatggcctggtggtcggtcacgttgcccccgaagccgctgtcggcggaaccatcggcctggtgcagggaggcgacagcatcaccgtggatgccgaccagttgctgctgcaactcaacgtggatgaggcggaactcacgcgacgccgggcagcctggagcaagccggaaccccgttatcgcactgggattctgggcaagtacgcccgtctggtgtccagttcaagccgtggagcggtcaccgaccagcccgactga

SEQ ID NO: 260 - protein, 557 aa, Synechococcus sp.
MLRSDAVTKGIQRSPNRAMLRAVGFGDEDFGKPILGIANGYSTITPCNVGLNDLSRRAEEAARQAGGMPQMFGTITVSDGISMGTEGMKYSLVSREVIADAIETACNGQSMDGVLAVGGCDKNMPGAMLAMARMNIPAVFVYGGTIKPGKLGGCDLTVVSAFEAVGQLTSGNIDEDQLTAVEKNACPGAGSCGGMFTANTMSAAIETMGLSLPYSSTMAAEDEEKADNAARSAEVLLDAVKANIRPLDLLTNDAFENAISVIMAVGGSTNAVLHLLAIARTAGVSLSIDDFERIRQRVPVICDLKPSGRYVTVDLHNAGGIPQVMRLLLDAGLLHGDCRTVEGKSLREVLADVPSVPPADQDVIRPLSNPLYGKGHLAILKGNLASEGSVAKISGVKTPVLTGPARVFESEEDCLAAILDQRIKAGDVVVVRNEGPVGGPGMREMLAPTSAIVGQGLGDRVALITDGRFSGGTYGLVVGHVAPEAAVGGTIGLVQGGDSITVDADQLLLQLNVDEAELTRRRAAWSKPEPRYRTGILGKYARLVSSSSRGAVTDQPD

SEQ ID NO: 261 - DNA, 1674 bp, Synechococcus sp.
atgctcagatccgacgccgttaccaaagggattcagcgatcccccaaccgcgccatgctccgggccgttggttttggtgatgctgatttcggcaaaccgatcctgggaatcgccaacggctacagcacgattacgccctgcaatatcgggcttgatgttttagcgaaacgtgccgaagaagcggcccgtctggctggaggaatgccgcaaatgtttggcaccatcacggtgagtgatggaatctcgatggggactgaagggatgaaatattcccttgtcagccgagaagtcatcgccgatgccatcgaaacggcctgtaacggtcagagcatggatggagtcttggcagttggtggctgcgacaaaaatatgcctggtgcgatgttggccatggcacggatgaatatcccctccgtgtttgtttatgggggaacgatcaagccgggaaaactcggcggctgtgatctcactgtggtgagtgcctttgaagccgttggtcaaatcaccagcggcaaaatcgatgaagaacaactcacggcggtggaaaagaacgcctgtcctggtgcaggaagttgcggcggcatgtttaccgccaacacgatgagtgcagccatcgaaacgatggggttaagccttccttacagctccacgatggcggccgaagaccaggaaaaagcggacagcgcggctcgctcagcagaggtgttggtggatgccgtgaaagccaacatccggccgctcgatctgctcacaaaacaagccttcgaaaacgccatcagcgtgatcatggcggtcggcggttccaccaatgccgttttgcatttgctggcgattgctcgcacagctggggttgatttgagcattgacgactttgaacgcattcggcaacgcgtcccagtgatctgcgatctcaaacccagcggtcggtttgtcaccgttgatctgcacaacgctggaggaatccctcaagtgatgaagttgctgcttgatgccggattgctccacggcgattgccaaacagttgaagggaaaagtctcaacgcattgttggcggatgtgccatctgcaccccccgcagaccaagaggtgattcgacctctgagcaatccgatgtacagcaaaggacaccttgccatcctcaaaggaaatttggccctggagggcagtgtggccaagatcagcggcgtcaaaactcctgtactgacgggtccagctcgggtttttgaaagtgaggaagactgtctggcctccatccttgagaaaaggatcaatgcgggagacgtcgttgtgatccgctacgaaggtccggtcggtggacctggcatgcgggaaatgttggcgcccacctcagccatcgtcggccagggactcggcgacaaagtggcattaattaccgatggacgatttagcggtggtacctacggactcgtggtgggtcacgtcgctccagaagccgctgttggtggaacgattggccttgtgcaagagggagacagcatcaccgtggatgccaatcaactcttgcttcagctcaatgttgacgacacggaattagccaaacgacgagcagcatggtcgaaaccaaaacctcaatacaccactggaattttgggtaaatatgcccgactcgtttccacatccagcaaaggggctgtcaccgatcaaccggattaa

SEQ ID NO: 262 - protein, 557 aa, Synechococcus sp.
MLRSDAVTKGIQRSPNRAMLRAVGFGDADFGKPILGIANGYSTITPCNIGLDVLAKRAEEAARLAGGMPQMFGTITVSDGISMGTEGMKYSLVSREVIADAIETACNGQSMDGVLAVGGCDKNMPGAMLAMARMNIPSVFVYGGTIKPGKLGGCDLTVVSAFEAVGQITSGKIDEEQLTAVEKNACPGAGSCGGMFTANTMSAAIETMGLSLPYSSTMAAEDQEKADSAARSAEVLVDAVKANIRPLDLLTKQAFENAISVIMAVGGSTNAVLHLLAIARTAGVDLSIDDFERIRQRVPVICDLKPSGRFVTVDLHNAGGIPQVMKLLLDAGLLHGDCQTVEGKSLNALLADVPSAPPADQEVIRPLSNPMYSKGHLAILKGNLALEGSVAKISGVKTPVLTGPARVFESEEDCLASILEKRINAGDVVVIRYEGPVGGPGMREMLAPTSAIVGQGLGDKVALITDGRFSGGTYGLVVGHVAPEAAVGGTIGLVQEGDSITVDANQLLLQLNVDDTELAKRRAAWSKPKPQYTTGILGKYARLVSTSSKGAVTDQPD

SEQ ID NO: 263 - DNA, 1677 bp, Synechococcus sp.
atggcccccctccgatccagcgccatcacgcaaggtgttcagcgcagtcccaaccgcgccatgttgcgcgctgttggtttcggagatggtgacttcagcaaaccgatcatcgggattgccaacggttacagcaccatcacgccctgcaatgtggggctcaacgatctagccctgcgcgccgaagcagccacacaagcagccggggggatgccgcaactcttcggcaccatcaccgtgagtgatggcatctccatgggcaccgaggggatgaagtactccctggtgagccgcgaagtgattgccgatgccatcgagaccgcctgcaacggtcaaagcatggatggcgtattggccatcggcggctgcgacaaaaacatgcccgccgccatgttggcgatggcgcggatgaacatcccaggtgtcttcgtctatggcggcaccatcaagcccggcaaattgggcggctgcgacctcaccgtggtcagcgcctttgaagcggttggtcagttgagcagcggcaagatcgatgaagcccagctcaccgctgttgaaaagaacgcttgcccaggagctggcagctgtggtggcatgttcacggccaacacgatgagtgcggccatcgaaacgatggggttgagcttgccgttcagctccaccatggcggcggaagatcccgagaaagccgagagcgctgctcgctcggctgaggtgttggtggaggccattgctgccaacattcgtccgttggatctgctgacccgcgaagcgtttgaaaacgccatcagcgtgatcatggccgtgggtggctccaccaatgcggtgttgcacttgctcgcgattgcacgcaccgccggcgtaccactgtcaatcgacgacttcgaaacgattcggcaacgggtgcctgtgatctgcgatctcaaaccaagcggacgctttgtaacggtcgacctgcacaacgctggtggcattccgcaagtcatgaaacttctgctcgatggtgggttgctccatggcgattgccgcaccgtggagggcaaaaccttgcgagaggttctggctgatgttccctcagaaccgccggctgatcaggaggtgatccggcccctgagcaatcccctctatgccaaagggcacctggctgtgttgaaaggcaacctcgccagtgaaggggctgtcgccaagatcagtggtgtcaaaacaccagtgctcacaggcccagccagggtgtttgaaagcgaagagcagtgcctgcaggcgatcttggcgaaccaggttcacgcaggtgatgtggtggtggtgcgcaatgaaggccccgttggtggcccgggaatgcgggagatgttggcgcccaccgccgccatcgttggtgaagggctcggcgacaaggtggcgttgatcaccgacggtcgcttcagcggcggcacctacggcctggtggttgggcatgtggccccagaagcagccgtaggcggcatgatcggcctggtgcaagagggcgattccatcaccgtggatgcccaacaacaattgctgcagctcaatgtggatgccgctgaattggagcggcgcaagcaagcgtgggtcaaaccagaaccgcgttaccgcaccggtgttttgggtaaatacgcccgtttggtgagcagcagcagcaagggcgctgtgactgatcaaccctga

SEQ ID NO: 264 - protein, 558 aa, Synechococcus sp.
MAPLRSSAITQGVQRSPNRAMLRAVGFGDGDFSKPIIGIANGYSTITPCNVGLNDLALRAEAATQAAGGMPQLFGTITVSDGISMGTEGMKYSLVSREVIADAIETACNGQSMDGVLAIGGCDKNMPAAMLAMARMNIPGVFVYGGTIKPGKLGGCDLTVVSAFEAVGQLSSGKIDEAQLTAVEKNACPGAGSCGGMFTANTMSAAIETMGLSLPFSSTMAAEDPEKAESAARSAEVLVEAIAANIRPLDLLTREAFENAISVIMAVGGSTNAVLHLLAIARTAGVPLSIDDFETIRQRVPVICDLKPSGRFVTVDLHNAGGIPQVMKLLLDGGLLHGDCRTVEGKTLREVLADVPSEPPADQEVIRPLSNPLYAKGHLAVLKGNLASEGAVAKISGVKTPVLTGPARVFESEEQCLQAILANQVHAGDVVVVRNEGPVGGPGMREMLAPTAAIVGEGLGDKVALITDGRFSGGTYGLVVGHVAPEAAVGGMIGLVQEGDSITVDAQQQLLQLNVDAAELERRKQAWVKPEPRYRTGVLGKYARLVSSSSKGAVTDQP

SEQ ID NO: 265 - DNA, 1671 bp, Synechococcus sp.
atgctccgctccgccgcgatcacccaggggattcagcgctctccgaatcgagccatgctccgtgctgtgggtttcggcgacggcgacttcaacaagccgatcatcggcatcgccaacggctacagcaccatcaccccctgcaatctggggctcaatgatcttgctcgacgcgccgaggaagccgcccatcaggtgggagcgatgccccagatgttcggcaccatcaccgtgagcgatgggatttcgatggggaccgaagggatgaaatattcccttgtgagccgggaggtgattgccgattcgatcgaaacggtcgtcaacgggcaaagcatggatgccctgctggcgatcggtggctgtgacaagaacatgcctggtgccatgctggcgatggcgaggatgaacgtcccctcgatcttcgtgtatggcggcaccatcaagcctggcaagctcggtgcctgtgacctcaccgtggtgagtgcctttgaggcggtgggccagttcagtggcggcaagatcgaggagcaggaactcacggcgatcgagaaaaacgcctgccctggggcgggcagctgcgggggcatgtttactgccaacaccatgagtgccgccttcgaggtgctggggctgagcttgccctacagctccacgatggcggccgaagaccccgagaaggccgatagcgccgcccgtagtgccgaggttttggccgacgccatcgaggcccagatcctcccgcgcgatctgatgacgcgcgaagccttcgaaaacgccatcagtgtgatcatggccgtgggtggctccaccaactccgtgctgcatctgctggctgtcgcccgcacggcgggggtggcgctgagcattgacgacttcgagcggatccggcagcgcgtgccggtgatctgtgatctcaagccaagtggccgcttcgtgacggtggatctgcaccgggctgggggcattccccaggtgatgaaactactgctcgatgcagggctcttgcacggcgactgccgcacgatcgaaggcaagacccttcacgaggtgctcgccgctgtgccgtcggtcccccccgccggccaggaggtgattcggcccctgagccatccgctgtatgccaaggggcacctggcgatcctcaaaggcaacctggccgaggaaggcgcggtggccaagatcagcggcgtcaaaaacccggtcatcaccggccctgcccgcgtgttcgagagcgaagaaacctgcctggccgccattctcgacaagcagatcaaccccggcgatgtggtggtcgtgcgcaatgaggggccggtgggcggtcctggcatgcgggagatgctcagccccacctccgcgatcgtgggccaggggctgctcgacaaggtggctctgatcaccgatggccgcttctcaggcggttcctacggcctggtgatcggccacgtggctccggaggccgccgtggggggcacaatcggcctggtgcaggaaggcgacagcatcaccgtggatgcgaatcagctgctgattcaactcaacgtggatgaatccgagctagctcaacgtcgcgccgcctggacccaacccgaaccccggtatcgcaccggcatcctcggcaaatacgcccgacaggtgagctccagcagtgtgggggcggtgaccgatcagccctga

SEQ ID NO: 266 - protein, 556 aa, Synechococcus sp.
MLRSAAITQGIQRSPNRAMLRAVGFGDGDFNKPIIGIANGYSTITPCNLGLNDLARRAEEAAHQVGAMPQMFGTITVSDGISMGTEGMKYSLVSREVIADSIETVVNGQSMDALLAIGGCDKNMPGAMLAMARMNVPSIFVYGGTIKPGKLGACDLTVVSAFEAVGQFSGGKIEEQELTAIEKNACPGAGSCGGMFTANTMSAAFEVLGLSLPYSSTMAAEDPEKADSAARSAEVLADAIEAQILPRDLMTREAFENAISVIMAVGGSTNSVLHLLAVARTAGVALSIDDFERIRQRVPVICDLKPSGRFVTVDLHRAGGIPQVMKLLLDAGLLHGDCRTIEGKTLHEVLAAVPSVPPAGQEVIRPLSHPLYAKGHLAILKGNLAEEGAVAKISGVKNPVITGPARVFESEETCLAAILDKQINPGDVVVVRNEGPVGGPGMREMLSPTSAIVGQGLLDKVALITDGRFSGGSYGLVIGHVAPEAAVGGTIGLVQEGDSITVDANQLLIQLNVDESELAQRRAAWTQPEPRYRTGILGKYARQVSSSSVGAVTDQP

SEQ ID NO: 267 - DNA, 1617 bp, Synechococcus sp.
atgttgcgggccgtgggcttcggcgacggtgacttcaacaagccgatcatcggcatcgccaatggctacagcacgatcacgccctgcaacatcggcctgaacgatctggcccgctgcgccgaggagtctgcccgtctggctggggccatgccacagatgttcggcacgatcaccgtcagcgacgggatctcgatgggcaccgaggggatgaagtattccctggtgagccgggaggtgatcgctgattcgatcgaaaccgcctgcaacgcccagagcatggatggcctgctggccatcggcggctgcgataagaacatgcccggcgccatgctggcgatggcgcgcatgaacatcccggcgatcttcgtgtacggcggcacgatcaaacccggccggctcggcccctgcgacctcaccgtggtgagtgccttcgaggctgttggtcagttctcgggcggtcgcatcgatgaggaggaactgctggcgatcgagaagaacgcctgccccggcgccggcagctgcggcggcatgttcaccgccaacacgatgagttcggcgttcgaagcgatgggcctgagcctgccgggcagctccaccatgacggccgaggatccggagaaggccgagagcgctgcccgctccgccgaggtgctggtgcgggccatcgaggcgaacatccgcccccgtgatctgatcacccgcgaggcgatcgagaacgccatcagcgtgatcatggcggtgggggggtccaccaattcggtgctgcacctgctggcgatcgcccgcaccgccgaggtgccgctcacgatcgacgatttcgagacgatccgtcagcgggtgccggtgatctgcgatctcaagcccagcggccgtttcgtgacggtggatctgcaccgggccggcggcattccccaggtgatgaagctgctgctggatgccggcctgctgcacggcgattgccgcaccatcgaaggcctcacgctcaagcaggtgctggcggaggtgcccagcgagccccccgccgatcaggacgtgatccggcccctctccaatccgctctatgccaagggtcacctggcgatcctcaagggcaacctggccgaggaaggggccgtcgccaagatcagtggcgtcaagaccccggtgatcacggggccggcccgggtgttcgagagtgaggagagcgccctggaggcgatcctcgccggtgaggtccatgccggtgatgtggtggtggtgcgctacgagggcccggtgggcgggcccggcatgcgtgagatgctctcgcccacggccgcgatcgtgggccagggcctgggggaatcggtggcgctgatcaccgacggtcgcttcagcgggggctcctacggcctggtggtgggccatgtggcccccgaggccgccgtgggcggcaccatcgccctggtgcaggagggcgacagcatcaccgttgatgcccatcagctgctcatccagctcaatgtggaaaccagcgagctggagcggcgccgggcggcctgggtcaggcccgaaccgcgctaccgcactggagtgctgggcaagtacgcccggctggtgagcagcagcagcctgggggcggtcaccgatcagggttga

SEQ ID NO: 268 - protein, 538 aa, Synechococcus sp.
MLRAVGFGDGDFNKPIIGIANGYSTITPCNIGLNDLARCAEESARLAGAMPQMFGTITVSDGISMGTEGMKYSLVSREVIADSIETACNAQSMDGLLAIGGCDKNMPGAMLAMARMNIPAIFVYGGTIKPGRLGPCDLTVVSAFEAVGQFSGGRIDEEELLAIEKNACPGAGSCGGMFTANTMSSAFEAMGLSLPGSSTMTAEDPEKAESAARSAEVLVRAIEANIRPRDLITREAIENAISVIMAVGGSTNSVLHLLAIARTAEVPLTIDDFETIRQRVPVICDLKPSGRFVTVDLHRAGGIPQVMKLLLDAGLLHGDCRTIEGLTLKQVLAEVPSEPPADQDVIRPLSNPLYAKGHLAILKGNLAEEGAVAKISGVKTPVITGPARVFESEESALEAILAGEVHAGDVVVVRYEGPVGGPGMREMLSPTAAIVGQGLGESVALITDGRFSGGSYGLVVGHVAPEAAVGGTIALVQEGDSITVDAHQLLIQLNVETSELERRRAAWVRPEPRYRTGVLGKYARLVSSSSLGAVTDQG

SEQ ID NO: 269 - DNA, 1671 bp, Prochlorococcus marinus
atgctcagatccgccgccatcacaaagggaactcaacgctctcccaaccgagccatgcttcgcgcagtgggctttggcgacgaagacttcaataaaccaatcatcggtatagccaacggctacagcacgatcactccttgcaacatcggtcttaatgacctggcgcgacgttcagaagaagcagcccgccaggccggtgcaatgccccagatgttcggcaccatcactgtcagtgatggcatctctatgggcaccgaagggatgaaatattccctggtaagtcgcgaggtgattgctgattcgatcgagacagcctgcaacgcccaaagcatggacggcgtactagcaatcggtggctgtgacaaaaacatgcctggagcgatgatcgccctggcccgaatgaacatcccaggtgtctttgtctatggcggaacgatcaaaccaggaaaattggctgaccgcgacctcactgtagtcagcgcctttgaagctgttggtcagcatgccagtggcaagataaatgaggagcaactcaccgctatcgagaagaacgcttgcccaggagcaggaagttgcggtggcatgtttacagccaacacgatgtcagccgctattgaaacattgggattgagtttgccttacagctcaacgatggctgcagaggatgaggaaaaagcaaatagcgcagcccgtagtgctgaagtgcttgtggatgccattaaggcaaatatctgtccccgcgatctactcaccaagaacgcatttgaaaacgcgattagcgttgtcatggcagtgggcggctccaccaatgcagttctgcatctgcttgcgattgcccgtagcgcaggcgtagacctttgcatcgatgacttcgagcgcatccgccagcgtgtaccggtgatttgtgatctaaaacccagcggccgttacgtgactgttgatttgcataacgcaggcggcattccccaagtgatgaaacagttgcttgatgcaggcttacttcatggagactgccgcaatgtggaaggtaaaaccttgagagaactgctcaaggatgtgccatccgagccttcagcagagcaagacgtcattcatcccctctcgaaaccggtctatgccaaggggcacctggcgatccttaaaggcaatctggccagcgaaggatgcgtggccaagataagcgggatcaaaaccccagtacttactggacctgcaagggtttttgaaagcgaggaggcctgccttgctgccattctcaacaacaaggtgaaggcgggagatgtcgtcgtcatacgtaacgaaggcccggttggcgggcctggaatgcgagagatgcttgctcctacatctgccatcgtcggtgaagaccttggcgacaaggtggccttaatcacagatggacgcttcagcggaggtacctatggtttggtggtgggccatgtggcaccggaagcagccgtaggcggcatgattggccttgtgcaggaaggcgacagcatcaccatcgatgccaatcaactgctgatccaactcaatgtcgagaaggatgaattggagcgtcgctccagcgcatgggaaaaaacacagccgcgttatcaaacaggagttctcggtaaatacgcccgaatggtgagtagcgccagcaatggtgctgtcaccgaccagccctga

SEQ ID NO: 270 - protein, 556 aa, Prochlorococcus marinus
MLRSAAITKGTQRSPNRAMLRAVGFGDEDFNKPIIGIANGYSTITPCNIGLNDLARRSEEAARQAGAMPQMFGTITVSDGISMGTEGMKYSLVSREVIADSIETACNAQSMDGVLAIGGCDKNMPGAMIALARMNIPGVFVYGGTIKPGKLADRDLTVVSAFEAVGQHASGKINEEQLTAIEKNACPGAGSCGGMFTANTMSAAIETLGLSLPYSSTMAAEDEEKANSAARSAEVLVDAIKANICPRDLLTKNAFENAISVVMAVGGSTNAVLHLLAIARSAGVDLCIDDFERIRQRVPVICDLKPSGRYVTVDLHNAGGIPQVMKQLLDAGLLHGDCRNVEGKTLRELLKDVPSEPSAEQDVIHPLSKPVYAKGHLAILKGNLASEGCVAKISGIKTPVLTGPARVFESEEACLAAILNNKVKAGDVVVIRNEGPVGGPGMREMLAPTSAIVGEDLGDKVALITDGRFSGGTYGLVVGHVAPEAAVGGMIGLVQEGDSITIDANQLLIQLNVEKDELERRSSAWEKTQPRYQTGVLGKYARMVSSASNGAVTDQP

SEQ ID NO: 271 - DNA, 1671 bp, Prochlorococcus marinus
atgcttagatcaaatgcaataacacagggtattcaacgatcaccaaaccgagcaatgcttagagctgttgggtttgatgataatgattttaacaagccaatcattggaatagctaatgggcacagcacaataaccccatgcaatatgggattaatggatttagctaatagagcagagtcagcgttaaaagaggctggtgcaatgcctcaaactttcggaaccataactgttagtgacggcatttccatgggaacggaagggatgaaatactcattagtttcaagagaagttattgcagattcaatcgagacggcttgcaatgctcaaagcatggatggggtgttagcgataggtggatgcgataaaaatatgccaggagcaatgttatcaatggcaagaatgaacataccttcgatttttgtttatggggggacaattaaacctgggaaattagacggttgcgacttgaccgtggtgagttcatttgaggctgtcggtcaattagcaagcggaaaaatcgacaaagatcgtttaatagctgtagaaaaaaatgctatccctggaccaggcagttgcggagggatgtttactgctaataccatgtctgcggcaatagaaacgatgggttttagtttgccatttagttcaacaatggctgcagtagatgatgaaaaagcagaaagcgctgctgaaagtgctcaggtccttgtaaatgcagtaaagaataacatcaggccattagatttacttacgaaagaagcctttgagaatgcaatcagtgtcatcatggctgtaggcggctcaacaaattctgtccttcacctacttgctatagctaggactgcaggagttgatttaacgatcgatgactttgaacgtataaggcagactgttcctgtgatttgcgacctcaaaccaagcggtaaatacgtaacagtcgacctacataaagctggtgggattcctcaagtaatgaaattactcctcgatgcaggaatgctacatggagaatgcaaaaccattgaaggaaaaacaattaaagaagttcttagagatatcccctcaaagcccaaagaaaatcaagacgttataagacaaatatcaaaccctatttataaaaaaggacatcttgctattctcaaaggaaatttagcaagtgaaggaagtgtcgcaaaaattagtggtgtaaagactcccgttttaaccgggcctgcaagggtctttgagagtgaagaagaatgcttaactgccattcttgacaataaagtaaaagctggagatgtagtcgtcgttaggtatgaaggacctgtaggagggcctgggatgagggagatgctctctccaacctcagcgattgtaggtcaaggtttaggagagaaagttgcactaattactgatggtcgatttagtggaggatcatatggattagtggttggccacgttgctccagaagcagccgtcggaggaacaattggattagtagaggaaggagacagtattaccgttgacgctaataaattgttaattcaattaaatgtcgaagagcgagaactagctagaagaaaacagaaatgggagaagccaaagcctagatataagacaggcattcttgggaagtattccagattagtaagttcatcaagccaaggagcgacaactgatcaaatataa

SEQ ID NO: 272 - protein, 556 aa, Prochlorococcus marinus
MLRSNAITQGIQRSPNRAMLRAVGFDDNDFNKPIIGIANGHSTITPCNMGLMDLANRAESALKEAGAMPQTFGTITVSDGISMGTEGMKYSLVSREVIADSIETACNAQSMDGVLAIGGCDKNMPGAMLSMARMNIPSIFVYGGTIKPGKLDGCDLTVVSSFEAVGQLASGKIDKDRLIAVEKNAIPGPGSCGGMFTANTMSAAIETMGFSLPFSSTMAAVDDEKAESAAESAQVLVNAVKNNIRPLDLLTKEAFENAISVIMAVGGSTNSVLHLLAIARTAGVDLTIDDFERIRQTVPVICDLKPSGKYVTVDLHKAGGIPQVMKLLLDAGMLHGECKTIEGKTIKEVLRDIPSKPKENQDVIRQISNPIYKKGHLAILKGNLASEGSVAKISGVKTPVLTGPARVFESEEECLTAILDNKVKAGDVVVVRYEGPVGGPGMREMLSPTSAIVGQGLGEKVALITDGRFSGGSYGLVVGHVAPEAAVGGTIGLVEEGDSITVDANKLLIQLNVEERELARRKQKWEKPKPRYKTGILGKYSRLVSSSSQGATTDQI

SEQ ID NO: 273 - DNA, 1674 bp, Prochlorococcus marinus
atgaataaacttagatcatctgctattacccaaggtgtgcaaaggtcacctaacagatcaatgttaagggcagttggttttaatgatgaagattttaacaaacctattattggggttgccaatggttacagcacaataaccccatgcaatatagggttaaataaattagctctcaaagctgaagagtcaattagacgatcagggggaatgcctcaaaaattcgggaccatcactgtaagtgatggcatttccatgggaacagaggggatgaaatattcattagtttcaagagaagtaatagctgactcgattgaaacagcatgtaatgctcaaagtatggatgcagtacttgctataggtggatgcgataaaaatatgcctggagcaatgatagcgattgcgaggatgaatattccctcaatatttatctatggaggaactataaaaccaggcaaattacatggggaagatcttacggttgttagtgcgttcgaagctgttggacagttaacatcaggcaaaattaatgagaaaaggttaatcgaagttgagaaaaattgtatccctggagctggaagctgtgggggaatgtttacggctaatacaatgtctgcagtaatagaagtgttaggtttaagccttccacacagttcaactatggctgctgaagatcttgaaaaagaactaagtgcagaaaaaagtgctgagatattagtatctgcgattaaaaaaaatataagaccattagacttaatgactaaaaaagcatttgaaaatgcaatatcagtaattatggccgtaggaggttcaacgaatgcagtattacatatattagcaatagcaaatactgcaggtattgatattaatattgatgactttgagaggataagacaaaaagttcctgtaatttgtgaccttaagccaagtggaaaatttgtaacagttgatcttcataatgcagggggaattccccaagttatgaaaatactcctaaatgcaggattaattcatggggaatgcaaaaacattgaaggcaaaactataactgaatacttacaaaacattccagataagcctcctagtaatcaaaatgtcatccgaggaatagattatcccctttataaaaaagggcatttagcaattttaaaagggaacctggcaaaggaaggttctgtagcaaaaattagtggagtaaaaaatccagttttaacaggtccagcaaagatattcgagagtgaagaagattgtcttaaagcaatcttaaataacgaaattatagctggtgatgttgttgttgtaagaaatgaaggtcctgtcggaggtccagggatgagagaaatgttatccccaacatcagcaattgttggacaaggacttggagaaaaagtggccttaattactgatggtaggtttagcggtggctcttatggtcttgttgtcgggcatatagcccctgaagcagctgtcggtggaaacattgctctaataaaagaaggtgatttgattacagttgatgctgtaaagcaactaattgaggttgatttatctgacgaagaattagaaaaaagaaaaaataattgggtaaaacctaaacctaaatataaaagaggaatactttcaaagtattcgaaaatagtaagtacatcaagtttaggggctgttactgatttatag

SEQ ID NO: 274 - protein, 557 aa, Prochlorococcus marinus
MNKLRSSAITQGVQRSPNRSMLRAVGFNDEDFNKPIIGVANGYSTITPCNIGLNKLALKAEESIRRSGGMPQKFGTITVSDGISMGTEGMKYSLVSREVIADSIETACNAQSMDAVLAIGGCDKNMPGAMIAIARMNIPSIFIYGGTIKPGKLHGEDLTVVSAFEAVGQLTSGKINEKRLIEVEKNCIPGAGSCGGMFTANTMSAVIEVLGLSLPHSSTMAAEDLEKELSAEKSAEILVSAIKKNIRPLDLMTKKAFENAISVIMAVGGSTNAVLHILAIANTAGIDINIDDFERIRQKVPVICDLKPSGKFVTVDLHNAGGIPQVMKILLNAGLIHGECKNIEGKTITEYLQNIPDKPPSNQNVIRGIDYPLYKKGHLAILKGNLAKEGSVAKISGVKNPVLTGPAKIFESEEDCLKAILNNEIIAGDVVVVRNEGPVGGPGMREMLSPTSAIVGQGLGEKVALITDGRFSGGSYGLVVGHIAPEAAVGGNIALIKEGDLITVDAVKQLIEVDLSDEELEKRKNNWVKPKPKYKRGILSKYSKIVSTSSLGAVTDL

SEQ ID NO: 275 - DNA, 1674 bp, Prochlorococcus marinus
atgaataaactcagatcatctgcaataacccaaggtgtgcaaagatcacctaacagatcgatgttaagagctgttggatttaatgatgaagattttaataaacctattattggagttgcaaatggatacagcaccataacaccatgcaatatgggtttaaataagttagctctaaaagctgaagagtctataaaaagatcaggtgggatgcctcagatgtttgggactataacagtaagtgatgggatttctatgggaacagagggcatgaaatattccctagtttcaagagaagttattgctgattcaattgaaacagcatgcaatgctcagagtatggatggagtacttgctataggtggatgtgataaaaatatgccgggtgccatgattgcgattgcaagaatgaatattccatcaattttcatttatggaggaacaataaagcctgggaaattgcatggagaagatcttactgttgttagtgcatttgaagctgttggacaattaacatcaggcaaaattaatgaagaaaggctaatccaagttgagaaaaattgtattcctggtgctggtagctgtggaggaatgtttacagctaatacaatgtctgcggttattgaagtattagggttaagtcttcctcacagttccactatggctgctgaagatcttgaaaaagaactaagtgcagacaaaagtgctgagatattagtctccgcaatagaaaaagatataagacctctagacctaatgactaagaaagcatttgaaaatgcaatatcagtaattatggcaattggcggatcaacaaatgcggtattgcacatcttagctatcgcgaatactgcaggaatagatatcaacattaatgattttgagagaatcagacaaaaagtacccgttatttgtgaccttaaaccgagtggtaaatatgtgacggtggatcttcataaggcaggtgggattccacaagtaatgaaaatacttttgaatgcaggattaattcatggcgattgcaaaaacattgaaggaaaaaccatctcagaatacttacaaaatattccagataagcctccaacaaatcaaaatgtcataagagacatagataaccctctttataaaaaaggacatctagcgatattaaaaggtaacttagcgagcgaaggttctgtagccaaaattagcggagtaaaaaaccctgtattaacaggtcccgcaaaaatttttgaaagtgaagaagattgtttaaaatcgatattaaataacgatatcaaagctggtgatgttgttgttattagaaacgaaggtcctgtaggaggaccaggtatgagagagatgttagctccaacatctgcaattgttggtcaagggctaggagagaaggtggctttaattaccgatggcagatttagcggcggtacctatggtcttgttgtgggtcacatagctccagaggctgctgtaggaggaaatattgctctaataaaacaaggtgatttaattacagtagatgctgtaaaacaactaattgaagttgatttatctgacgaagaattagaaaaaagaaaaaaagattgggtaaaacctattcaaaaatacaaaagaggaattctttcaaaatattcgagaatcgtaagcacatcaagtttaggggctgttactgatttataa

SEQ ID NO: 276 - protein, 557 aa, Prochlorococcus marinus
MNKLRSSAITQGVQRSPNRSMLRAVGFNDEDFNKPIIGVANGYSTITPCNMGLNKLALKAEESIKRSGGMPQMFGTITVSDGISMGTEGMKYSLVSREVIADSIETACNAQSMDGVLAIGGCDKNMPGAMIAIARMNIPSIFIYGGTIKPGKLHGEDLTVVSAFEAVGQLTSGKINEERLIQVEKNCIPGAGSCGGMFTANTMSAVIEVLGLSLPHSSTMAAEDLEKELSADKSAEILVSAIEKDIRPLDLMTKKAFENAISVIMAIGGSTNAVLHILAIANTAGIDININDFERIRQKVPVICDLKPSGKYVTVDLHKAGGIPQVMKILLNAGLIHGDCKNIEGKTISEYLQNIPDKPPTNQNVIRDIDNPLYKKGHLAILKGNLASEGSVAKISGVKNPVLTGPAKIFESEEDCLKSILNNDIKAGDVVVIRNEGPVGGPGMREMLAPTSAIVGQGLGEKVALITDGRFSGGTYGLVVGHIAPEAAVGGNIALIKQGDLITVDAVKQLIEVDLSDEELEKRKKDWVKPIQKYKRGILSKYSRIVSTSSLGAVTDL

SEQ ID NO: 277 - DNA, 1680 bp, Prochlorococcus marinus
atgaataaattaagatcttctgcaataactcaaggtgttcaaagatctcctaacagatcaatgttaagagcagttggatttagtgatgatgatttcactaaaccaatcattggagtcgctaatggatatagcaccattacaccctgcaatatgggccttaacaagttagctcttaaggcagaagattcaataaggaaatcaggaggaatgcctcaaatgttcggaactatcaccgtaagcgatgggatctccatgggaacagaaggaatgaaatattctttagtttcaagggaagtaatagccgattcaatagaaactgcctgtaatgcgcaaagtatggatggtgttttagctattggtggttgtgataaaaatatgccgggtgcaatgatagcaattgcaagaatgaatatcccttccatatttatttatggaggaacaataaaacctggaaagttaaacggtgaagacttaacggttgtcagtgcatttgaagctgttgggcaattaacctcgggtaaaataaatgagaagagattaaatgaagttgagaaaaattgtattccaggagcaggaagttgtggaggaatgttcacagctaatactatgtcagcagttatagaagtcttaggtttaagtcttcctcatagttcaacaatggcagccgaagattatgagaaggtggtaagtgctgaaaaaagcgctgaaatacttgtagatgcaataaaaaaagatataaggccactagatcttatgactaaagaatcttttgaaaatgcaatatctgtaattatggctattggaggttcgacaaatgcagtgcttcacatattagcgatagcgaatactgcaggtatagagatcaatattgatgattttgaaagaataagacaaaaagttcctgtgatttgtgatttgaaacctagcggcagatatgtcacagtagatcttcataatgcaggaggcattccacaagtaatgaaaatacttttaaatgcaggattaataaatggtgattgcaaaaatatcgaaggtaaaacaatatctgaatatttacttaatattccagataatcctcctgaaaatcaaaatgttattagaaacataaataatcctctttataaaaaaggtcatttagcaatattaaaaggtaatttagcttcggaaggttgtgtagcaaaaatcagcggagtaaagaatccagttttaaagggtcccgctcgaatttttgaaagtgaggaagattgtcttaaatcaattttgaataatgatattaaagctggtaatgttgtcgttataagaaatgaaggtcctgtgggaggaccgggaatgagagaaatgttagctccaacatctgcaattgttgggcaagggctgggagaaaaagtagctttaataactgatggtagatttagtggaggtacctatggccttgttgttggacatatcgcaccagaggcagcagtaggagggaatatagctttaataagagagggagatttaatcactgttgatgctgtaaaccaattaattgaagttgaactatctgatggggaattagaaaaaagacgaattaactggataaagcctattccgaaatataagaaaggtgtactttcaaaatattcaagaattgtaagtacttcaagcttaggtgcagttacagatctggaaaaataa

SEQ ID NO: 278 - protein, 559 aa, Prochlorococcus marinus
MNKLRSSAITQGVQRSPNRSMLRAVGFSDDDFTKPIIGVANGYSTITPCNMGLNKLALKAEDSIRKSGGMPQMFGTITVSDGISMGTEGMKYSLVSREVIADSIETACNAQSMDGVLAIGGCDKNMPGAMIAIARMNIPSIFIYGGTIKPGKLNGEDLTVVSAFEAVGQLTSGKINEKRLNEVEKNCIPGAGSCGGMFTANTMSAVIEVLGLSLPHSSTMAAEDYEKVVSAEKSAEILVDAIKKDIRPLDLMTKESFENAISVIMAIGGSTNAVLHILAIANTAGIEINIDDFERIRQKVPVICDLKPSGRYVTVDLHNAGGIPQVMKILLNAGLINGDCKNIEGKTISEYLLNIPDNPPENQNVIRNINNPLYKKGHLAILKGNLASEGCVAKISGVKNPVLKGPARIFESEEDCLKSILNNDIKAGNVVVIRNEGPVGGPGMREMLAPTSAIVGQGLGEKVALITDGRFSGGTYGLVVGHIAPEAAVGGNIALIREGDLITVDAVNQLIEVELSDGELEKRRINWIKPIPKYKKGVLSKYSRIVSTSSLGAVTDLEK

SEQ ID NO: 279 - DNA, 1680 bp, Prochlorococcus marinus
atgaataaattaagatcatctgcaataactcaaggtgtccaaagatctcctaacagatcaatgttaagagctgttggttttagtgatgaagattttactaaacctataattggagttgctaacggatttagtactatcacaccatgcaatatgggtctaaacaagttagctctaaaagctgaagaatcaataagagaagcaggaggtatgcctcagatgttcggaaccatcaccgtaagtgatggaatctctatgggaacagagggaatgaaatattccctagtttcaagagaggttatagctgattcaatcgaaacagcatgcaatgcgcaaagtatggatggggttttagctattggaggttgtgataaaaatatgccaggagcaatgattgcaattgcaagaatgaatatcccatccatatttatttatggaggaacaataaaacctggtaaattaaatggtgaagatcttacagttgtcagtgcatttgaagctgttgggcaattaacttctgggaaaataaatgagaagagattaattgaagttgaaaaaaattgtatcccaggagctggaagttgtggaggaatgtttacagctaacactatgtctgctgttatagaagtcttgggtttaagtcttccatatagttcaacaatggcagctgaagattacgaaaaggaagttagcgctgaaaaaagtgctgaaatattagttgatgcaattagaaaagatattagacctttaactctcatgactaaagaatcatttgagaatgcaataactgtcattatggctattggaggttcaactaatgccgttctccatatattagcaatagcaaatacagcaggtatagatatcaatattgatgatttcgaaagaataagacaaaaagtacctgtaatttgcgacttaaaacccagcggtaaatacgtaacagtcgatcttcataaagcaggtggaattccacaagttatgaaaatacttctaaacacaggtttgatacatggtaattgtagaaacatagagggtaaaacagtagttgaatccttaaaagatattccagttaaacctccagagaatcaggatgtcattcgagatattgataatccactttataaaaaaggtcacttagcgattctaaaagggaacttagcctcggaaggttgtgtagccaaaattagtggaataaagaatcctgtattaaaaggacctgctcgcatctttgagagtgaggaggattgtctcaaatcaattttgaataatgatattaaagctggtaatgttgttgttataagaaatgaaggtcctgtgggcggaccagggatgagagaaatgttggcaccaacatccgcaattgttgggcaaggacttggagaaaaagtagcgctaataactgatggtagatttagtggaggcacctatggcctagttgttggccacattgcaccagaggcagcagttggaggaaatatagcgttaataaaagaaggcgatttaataactgttgatgctacaaaccaattaatcgaagttgaactatctgatgaggaattagaaatgagaagaattaactgggaaaagcctagtaaaaaatataaaaaaggagttctttctaaatattcaagaattgttagcacctcaagcctaggagccgttacagatttggaagaataa

SEQ ID NO: 280 - protein, 559 aa, Prochlorococcus marinus
MNKLRSSAITQGVQRSPNRSMLRAVGFSDEDFTKPIIGVANGFSTITPCNMGLNKLALKAEESIREAGGMPQMFGTITVSDGISMGTEGMKYSLVSREVIADSIETACNAQSMDGVLAIGGCDKNMPGAMIAIARMNIPSIFIYGGTIKPGKLNGEDLTVVSAFEAVGQLTSGKINEKRLIEVEKNCIPGAGSCGGMFTANTMSAVIEVLGLSLPYSSTMAAEDYEKEVSAEKSAEILVDAIRKDIRPLTLMTKESFENAITVIMAIGGSTNAVLHILAIANTAGIDINIDDFERIRQKVPVICDLKPSGKYVTVDLHKAGGIPQVMKILLNTGLIHGNCRNIEGKTVVESLKDIPVKPPENQDVIRDIDNPLYKKGHLAILKGNLASEGCVAKISGIKNPVLKGPARIFESEEDCLKSILNNDIKAGNVVVIRNEGPVGGPGMREMLAPTSAIVGQGLGEKVALITDGRFSGGTYGLVVGHIAPEAAVGGNIALIKEGDLITVDATNQLIEVELSDEELEMRRINWEKPSKKYKKGVLSKYSRIVSTSSLGAVTDLEE

SEQ ID NO: 281 - DNA, 1671 bp, Prochlorococcus marinus
atgcttcgatccagtgcaatcacccaaggaattcagagatcaccaaatagggctatgctccgagcggttggatttaatgataatgattttaacaagccaataattggtattgctaatgggtacagcacaattacaccatgcaatgttggattaaataacctagccctacacgcagaagcctcaacaaaagtatcaggcgctatgccacaaatgtttggcacaataactgttagcgatggaatatctatggggaccgaagggatgaaatattcactagtttcaagagaggttatagccgattcaatagagacagcatgtaatgctcaaagcatggacggtgttcttgcaataggaggatgtgataaaaatatgcctggagccatgattgccatggcaagaatgaatatacccgcaattttcgtgtatggagggacaattaaaccagggaaattagacggttgtgatttaacagtagtaagtgcatttgaagccgttgggcaattaacaagtggaaagattactgaagataaacttattgctgtagaaaagaattgtattcctggagcaggaagttgtggaggaatgttcacagctaataccatgtccgcagcaatagaaacgctcggattaagcttgccttatagctcaacaatggctgctgaagataaggaaaaaatagagagtgctgagcgtagtgccaaagtcctggtagatgcaattgaaaaaaatatacgtcctttagacctcctaaccaagaaatcatttgaaaatgctattgccgtagtcatggctgttggcgggtcgacaaatgccgtattacatttattagctattgctaggtcatcaggagtggacttatgcatagatgattttgaaagaattcgacagaaggtacctgtgatttgtgatttaaagccaagtggcaaatatgtcactgtagatctacataaagctggtggaatacctcaggtaatgaagctgcttttagatgcgggcttattacatggtgattgtttaactattgaaggtataactatcgatgagtccttaaaaaatatcccttcagagccaccagcgaaccaaaatgtgatatctccaatcacaaagccaatatataaaaaaggacatctagcaatcttaaaaggaaatctcgcaaccgaaggatgcgtagccaaaataagtgggattaggaccccagtgttgaaaggtccagcaaaagtatttgaaagtgaagaagactgtctcgacgcaatcttaaaagaacagatacaagaaggagatgtaatagttattagaaacgaaggccctgtaggaggacccggaatgagagaaatgttagcaccaacctctgccatagttggacaaggcctaggggataaggttgctctaataacagatggacgttttagcggtggtacttatggtttggtagtgggacatatagcaccagaagcatcagtgggagggaatatagccctagtcaaagaaggtgacatgattactgttgacgcgcacaaaaagttgattcaattggaagtagatgaaaaggagctctcaaaaaggaggactttatgggaaaaaccagaagttaaatataagactggaatactaggtaaatatgcgcgtttagttagcagttcaagcaagggtgctgtaactgatcaaccatga

SEQ ID NO: 282 - protein, 556 aa, Prochlorococcus marinus
MLRSSAITQGIQRSPNRAMLRAVGFNDNDFNKPIIGIANGYSTITPCNVGLNNLALHAEASTKVSGAMPQMFGTITVSDGISMGTEGMKYSLVSREVIADSIETACNAQSMDGVLAIGGCDKNMPGAMIAMARMNIPAIFVYGGTIKPGKLDGCDLTVVSAFEAVGQLTSGKITEDKLIAVEKNCIPGAGSCGGMFTANTMSAAIETLGLSLPYSSTMAAEDKEKIESAERSAKVLVDAIEKNIRPLDLLTKKSFENAIAVVMAVGGSTNAVLHLLAIARSSGVDLCIDDFERIRQKVPVICDLKPSGKYVTVDLHKAGGIPQVMKLLLDAGLLHGDCLTIEGITIDESLKNIPSEPPANQNVISPITKPIYKKGHLAILKGNLATEGCVAKISGIRTPVLKGPAKVFESEEDCLDAILKEQIQEGDVIVIRNEGPVGGPGMREMLAPTSAIVGQGLGDKVALITDGRFSGGTYGLVVGHIAPEASVGGNIALVKEGDMITVDAHKKLIQLEVDEKELSKRRTLWEKPEVKYKTGILGKYARLVSSSSKGAVTDQP

SEQ ID NO: 283 - DNA, 1677 bp, Prochlorococcus marinus
atgaagcttagatcaagcgcaataactcaaggcgtacagagatcgccaaacagagcaatgcttcgtgctgttgggtttgaagacgatgatttcaacaaaccaataataggtattgcaaatgggtatagcactatcacgccttgtaatattgggctaaatgatttggcaaaacaagcagaaaaagcaataaaggattgggatggtatgcctcaaatgtttggaacaattactgttagtgatggaatatctatggggactgaagggatgaaatactccttggtctctagagaagtaatagccgattcaatagaaactgcatgcaatgctcaaagcatggatggagtgttagcaataggtggttgcgataaaaacatgcctggtgcaatgctagccatggcaagaatgaatattccagggatatttgtttatgggggaacgatcaaaccaggaaaattaaatggcgaggatttgacagttgtaagtgcatttgaagctgtggggcaattaactagtgggaaaataacaaaagaaaaattgattgaggttgaaaaacattgcattccaggggctggtagttgtggaggtatgtttacagcaaacacaatgtcagcagccattgaagctatgggactaagtcttcctcacagttcaaccatggctgctgaggatcaagaaaaaataaaaagtactcaaaaaagtgccgaggttcttattaaagctatcaaggaaaatattcgcccattagatttattaaccaagcaagcattcgagaatgcaataagtgtagtaatggcagttgggggctctacaaatgctgtgcttcatcttttagcaattgctcattcatcgggagttgaactttctcttgacgaatttgaaaagatacgtcaacgagttccggtactttgtgatttaaagcccagtggtaaatatgtgactgttgacctacacaaagcaggaggcattccacaagtcatgaaaatacttcttgaagcaggattgattaatgaaaattgtagaacaatagaaaacaaaacaatcaaggaaatgctgctcgatgttcccgcagagcccccatcagatcaggatgttattcggcctttcgattcgccggtctataaaaaaggtcatttagcaattctcaaaggaaatcttgcaactgagggaagcgttgcaaaaatcagtggtataaaagaaccaatccttacaggtccagcaaaagtatttgaaagtgaagaagattgcttaaaagcaatacttactgaacaaattcactcaggtgatgtagtagtcataagaaatgaaggcccagttggtgggccagggatgagagaaatgctcgctccaacatctgcaattgttggtcaaggtcttggtgaaaaagttgctttaattactgacggacgttttagtggcggaacatatggactagtagttggtcatgtcgcaccagaagcagccgttggagggaatattgctctaattcaagatggtgacagcataactgttgatgctattcaaaaactcattcaagtaaatatcgaagaagcagaattaaaaagacgacgttcactttgggttaagccaaagcccaaatacaattcaggagttcttgggaaatatgcaactttggttagtagttcaagcaaaggtgctgtaactgatcagaactgttaa

SEQ ID NO: 284 - protein, 558 aa, Prochlorococcus marinus
MKLRSSAITQGVQRSPNRAMLRAVGFEDDDFNKPIIGIANGYSTITPCNIGLNDLAKQAEKAIKDWDGMPQMFGTITVSDGISMGTEGMKYSLVSREVIADSIETACNAQSMDGVLAIGGCDKNMPGAMLAMARMNIPGIFVYGGTIKPGKLNGEDLTVVSAFEAVGQLTSGKITKEKLIEVEKHCIPGAGSCGGMFTANTMSAAIEAMGLSLPHSSTMAAEDQEKIKSTQKSAEVLIKAIKENIRPLDLLTKQAFENAISVVMAVGGSTNAVLHLLAIAHSSGVELSLDEFEKIRQRVPVLCDLKPSGKYVTVDLHKAGGIPQVMKILLEAGLINENCRTIENKTIKEMLLDVPAEPPSDQDVIRPFDSPVYKKGHLAILKGNLATEGSVAKISGIKEPILTGPAKVFESEEDCLKAILTEQIHSGDVVVIRNEGPVGGPGMREMLAPTSAIVGQGLGEKVALITDGRFSGGTYGLVVGHVAPEAAVGGNIALIQDGDSITVDAIQKLIQVNIEEAELKRRRSLWVKPKPKYNSGVLGKYATLVSSSSKGAVTDQNC

SEQ ID NO: 285 - DNA, 1707 bp, Nodularia spumigena
atggaaggaaaaaaaatgtcggagaatttaagaagccaagttgttacccaaggagtgcagcgatcgcctaatcgagctatgctgcgtgcagtgggttttaaggacgaagattttaataaagccattgtcggcattgctaatggctacagtacaatcactccctgcaatatgggaattaataaactagcactaagagccgaaattggcgtaagagaagctggggcaatgccgcaaatgttcggtactatcaccattagtgatgggatttctatgggaaccgaggggatgaaatattccctagtgtcacgagaagttattgctgattccattgaaaccgcctgtactggacaaagtatggatggcgttttggctattggtggctgtgataaaaatatgccaggggcaatgctagcgatggcgcgcatgaatattcctgctatttttgtttatggtggcacaattaaacccggtcactacgatggtaaagatttaaccgtcgtgagttcctttgaagcagttggtcaatacagcgccggtaaaattgatggtgatgaactcttagcagtggaacgtgaagcttgtcctggtgctggttcctgcggtgggatgtttacagcaaataccatgtcttccgcttttgaagcaatgggcatgagcttaccttattcttccacaatggcagccgaagatgctgaaaaagccgacagtacgcaaaaatcagcagttgctttagtagaagccatacgtaagcaaatcttacctcggcagattatcacccgtaaatctatagaaaatgccatttcagtaattatggcagtgggtggttccacaaatgcagtattgcactttttagcgatcgctcgtgcagctggagtagaactcacactagatgattttgaaaccatccgtggacgtgtcccagttatctgtgatttaaaacccagtggtaaatatgtcgccacagacctgcacaaagctggcggaatacctcaagtcatgaaaatgttacttgtgcatgatttactccacggcgactgcttaactatcacaggtaaaacagtagcagaagtcttagcagatatctccgcagaaccacgtaccgaccaagatgtgattcgtccttggaataaccccatgtatgctcaaggacacttagccatcctcaaaggcaacctagccacagaaggggctgtagccaaaatcaccggagttaaaaagccgattattactggccctgcacgggtatttgagtctgaggaatcctgtttagatgccatcctcgcaaataaaattaatgccggggatgttctcataattcgttacgaaggtcccaagggtggccctggtatgagagaaatgcttgctcccacctcagcaattattggggctgggttaggcgatgcagtaggtttaattactgatgggcgcttttccggcggtacttacggcatggtagttggtcacgtagccccagaagcagccgttggtggtgcgatcgctcttgtagaagaaggtgatagcattaccattgatgcctctaatcgcctcttgcaattgaacgtctcagatgaagaattagcccgtagacgtgccaattggcaaccccttccaccccgttacaccaaaggcgtacttgctaaatatgccaaattagtatcttctagcagtgttggagcagtcacagatttagacttatttaatggttag

SEQ ID NO: 286 - protein, 568 aa, Nodularia spumigena
MEGKKMSENLRSQVVTQGVQRSPNRAMLRAVGFKDEDFNKAIVGIANGYSTITPCNMGINKLALRAEIGVREAGAMPQMFGTITISDGISMGTEGMKYSLVSREVIADSIETACTGQSMDGVLAIGGCDKNMPGAMLAMARMNIPAIFVYGGTIKPGHYDGKDLTVVSSFEAVGQYSAGKIDGDELLAVEREACPGAGSCGGMFTANTMSSAFEAMGMSLPYSSTMAAEDAEKADSTQKSAVALVEAIRKQILPRQIITRKSIENAISVIMAVGGSTNAVLHFLAIARAAGVELTLDDFETIRGRVPVICDLKPSGKYVATDLHKAGGIPQVMKMLLVHDLLHGDCLTITGKTVAEVLADISAEPRTDQDVIRPWNNPMYAQGHLAILKGNLATEGAVAKITGVKKPIITGPARVFESEESCLDAILANKINAGDVLIIRYEGPKGGPGMREMLAPTSAIIGAGLGDAVGLITDGRFSGGTYGMVVGHVAPEAAVGGAIALVEEGDSITIDASNRLLQLNVSDEELARRRANWQPLPPRYTKGVLAKYAKLVSSSSVGAVTDLDLFNG

SEQ ID NO: 287 - DNA, 1701 bp, Nostoc punctiforme
atgtcggagaatttgagaagccaagtagtgacgcaaggagtgcagcgatcgccaaatcgagctatgctgcgggcagttggttttaaagatgaagatttcaataaagccattgtcggtatagccaacggttacagcacgatcaccccctgcaatatggggataaatcaactggcacagagggcagaagctgggattaaaaccgccggagcaatgccgcaaatatttggcacaattaccatcagcgacgggatttcaatgggaaccgaagggatgaaatattccctagtatcgcgggaagttatcgccgattccatcgaaaccgcctgtaccggacaaagtatggatggtgtactagccattggtggctgtgataagaatatgccaggcgcaatgctagcgatcgcgcggatgaatatcccggcaatattcgtttacggtggcacaattaaacccggtcactacaacggacgcgatttaaccgttgtcagttcttttgaagctgttggtcaatacagtgcgggaaaaattgacgacaaggaattattagaagtcgaaagtcgcgcttgtcctggcgctggttcctgcgggggaatgttcacagctaacaccatgtcttcagcatttgaagcgatgggaatgagtttaccctattcttccacaatggcagccgaagatgccgaaaaagccgacagcacggaaaaatcagcctttgtgctagtcgaagccatcaagaagcaaatcttaccccggcaaattatcacccgtaaatctatagagaatgccatctctgtgattatggcggtgggtggttcgaccaatgcagtattgcatttcttagcgatcgcccgcgctgcgaatgtagagttaaccctagatgactttgaaacaatccgcgcccgtgttcccgttttgtgcgatctaaaaccaagcggtaaatatgtcgctacagatttgcacaaagctggtggcattccgcaagtcatgaagatgctactcgcacatggcttattgcatggtgatagtctcaccattagcggtcaaaccattgcagagatattagcagacatacccgaagagccatctgccaatcaagatgtgattcgggcttggaataacccgatgtatgctcaaggacatttagccatcctcagaggtaatctggcaacggaaggggctgtcgctaaaattaccggcgtgaaaaaaccagtcattaccgggcctgcacgggtgtttgagtcggaagaagcctctttagatgcaattttggcgggtaaaattcaagctggtgatattttggttattcgctacgaagggcccaaaggcggccctggaatgcgagaaatgttggctcccacttcggcaattatcggggctggcttgggtgatgcggtgggattaattaccgatgggcgcttttctggcggtacttatggcatggtggttggtcatgttgctccagaagcagcagtgggtggtgcgatcgcgcttgttgaagaaggcgatagtattaccattgatgcacccgcacgccttttgcagttgaatatatctgaagaagaattagctcgtcgtcgtgctaattggcaacctcccgctccacgttacaccaaaggcgtgttggcgaaatatgccaaactggtatcttctagcagcatcggtgctgtgacagatttggatttgttcaaaccacaacagaactaa

SEQ ID NO: 288 - protein, 566 aa, Nostoc punctiforme
MSENLRSQVVTQGVQRSPNRAMLRAVGFKDEDFNKAIVGIANGYSTITPCNMGINQLAQRAEAGIKTAGAMPQIFGTITISDGISMGTEGMKYSLVSREVIADSIETACTGQSMDGVLAIGGCDKNMPGAMLAIARMNIPAIFVYGGTIKPGHYNGRDLTVVSSFEAVGQYSAGKIDDKELLEVESRACPGAGSCGGMFTANTMSSAFEAMGMSLPYSSTMAAEDAEKADSTEKSAFVLVEAIKKQILPRQIITRKSIENAISVIMAVGGSTNAVLHFLAIARAANVELTLDDFETIRARVPVLCDLKPSGKYVATDLHKAGGIPQVMKMLLAHGLLHGDSLTISGQTIAEILADIPEEPSANQDVIRAWNNPMYAQGHLAILRGNLATEGAVAKITGVKKPVITGPARVFESEEASLDAILAGKIQAGDILVIRYEGPKGGPGMREMLAPTSAIIGAGLGDAVGLITDGRFSGGTYGMVVGHVAPEAAVGGAIALVEEGDSITIDAPARLLQLNISEEELARRRANWQPPAPRYTKGVLAKYAKLVSSSSIGAVTDLDLFKPQQN

SEQ ID NO: 289 - DNA, 1692 bp, Nostoc sp.
atgtcggagaattttagaagcaaggctatcacacaaggggtacagcgatcgcctaacagagcaatgctgcgggctgttggttttcaggatgcagattttaccaaagccattgtaggtgttgccaatggttacagcacgattaccccgtgtaatatggggataaatcaactagcacaaagggcagaagctggtataaatactgctggagcaaagccgcaaatattcggtacaattacgattagtgatgggatttcgatgggaaccgaagggatgaaatattccctggtatcacgagaagtaatcgctgactccattgaaaccgtttgtaatgggcaaagtttagacggggtaattgccattggtggctgtgataagaatatgccaggggcaatgattgcgatcgcccggataaatatccctgctatctttgtttacggtggcacaattaaacccggacattacaacggtaaagatttaactgttgtcagttcttttgaggctgttggtgagtacagcgccggtaaaattgacgaaaatgaactgttagcagtagaacgcaatgcttgtcctggtgcaggttcctgcggtgggatgtacacagcaaataccatgtcctctgcttttgaagcactggggatgagtttgccctattcgtctacaatggcggcagaagatgacgaaaaagctgatagtacggaagaatcagccaaggtattggtagaggcgattcgtcatcaattattacccagacagattatcactcgtaagtccatagaaaacgccatatctgtaattatggctgtgggtggttctactaatgcggtgttacattttctagcgatcgcccgtgcggctggtgtagaactaaatctggacgactttgaaactattcgtggtcgtgtccccgttttgtgcgacttgaaaccaagcggtagatatgtggctacagacctgcacaaagctggtggtataccccaagtcatgaaaatgttactcgtgcatggtttactccacggcgactgtatgaccatcacaggtaaaaccattgccgaagttttagcagatatcccagaagaaccatcgcctaatcaagatgtaattcgtccttggaataaccccatgtatgcccaaggccacttggctatactcaaaggtaatttggcaacagaaggcgcagttgccaaaattactggtgtgaaaaatcctgtgattacagggccagccaaagtatttgaatcagaagaggattgtttagatgcaattttggcaggtaaaattaaagccggtgacgtgattgtcatccgctacgaaggccccaaaggcggccctgggatgcgagaaatgttagcccccacctcagctattatcggtgcaggtttaggcgactcagtgggactaattaccgatggacgcttctccggtggtacttacggtatggttgtgggacacgttgcaccagaagcagccgttggtggggcgatcgctctggtacaagaaggtgatagcatcacaattgatgcccacgcccgttctttgcagttgaacatatcagacgaagaattaacccgtcgtcgtgccaattggcaaccccgtcccccacgttacactacaggcatactggcaaaatacgccaagttggtagcttctagtagtgtgggtgctgtcaccgatttagacttattcaataaatag

SEQ ID NO: 290 - protein, 563 aa, Nostoc sp.
MSENFRSKAITQGVQRSPNRAMLRAVGFQDADFTKAIVGVANGYSTITPCNMGINQLAQRAEAGINTAGAKPQIFGTITISDGISMGTEGMKYSLVSREVIADSIETVCNGQSLDGVIAIGGCDKNMPGAMIAIARINIPAIFVYGGTIKPGHYNGKDLTVVSSFEAVGEYSAGKIDENELLAVERNACPGAGSCGGMYTANTMSSAFEALGMSLPYSSTMAAEDDEKADSTEESAKVLVEAIRHQLLPRQIITRKSIENAISVIMAVGGSTNAVLHFLAIARAAGVELNLDDFETIRGRVPVLCDLKPSGRYVATDLHKAGGIPQVMKMLLVHGLLHGDCMTITGKTIAEVLADIPEEPSPNQDVIRPWNNPMYAQGHLAILKGNLATEGAVAKITGVKNPVITGPAKVFESEEDCLDAILAGKIKAGDVIVIRYEGPKGGPGMREMLAPTSAIIGAGLGDSVGLITDGRFSGGTYGMVVGHVAPEAAVGGAIALVQEGDSITIDAHARSLQLNISDEELTRRRANWQPRPPRYTTGILAKYAKLVASSSVGAVTDLDLFNK

SEQ ID NO: 291 - DNA, 1686 bp, Trichodesmium erythraeum
atgccagagaatttgagaagtcaattagtcaccaaaggagtacaacgcgctcccaaccgagctatgctgagagctgtgggttttgaagattcagactttaccaaaccaattattggggttgccaatgcccatagcactattactccctgcaacatgggtattaatgatttggccatgagagctgtaagtggagtgaaagaagctggaggaatgccgcagatatttggaactattactattagcgatggaatttctatgggtactgaggggatgaaatattctctggtttctagagacgttattgctgattccatcgaaacagtttgtaatggccaaacaatggatggagttctagctattggtggatgcgataaaaatatgccaggagcaatgatagcgatcgctaggatgaatattcctgctatcttcgtatacggtggtactattaaaccaggcaactacaacggtaaagacctaacagttgtaagtgcttttgaagcagtgggagaatatagtgctggaaaaattgacgaaacagaattaacagaagttgaacgtagagcttgccctggtgctggttcctgtggaggaatgtttactgccaatactatgtcttcagcttttgaagcaatgggtatgagtctcatgtattcatcaacaatggctgcagaagatgcagaaaaagcagatagcacagaaaaatcagctcatgttttagtagaagctattcgcaaacaaattttacctagtcaaattattacccgtaaagctatcgaaaatgcaatttcagtaattatggctgtagggggttccactaatgcagtactacacctattagcaattgcttatgctgcaaatgtgaagttatctttagatgattttgaaataattagggccagagtacctgtattatgtgatttgaaacctagtggtaaatacgttacaacaaatttgcatcaagcgggtggaattcctttagtaatgaaaatgcttttagaacatgatttactccacccagatgctttaaccataacaggtaagactattggagagcaattaacaaatataccttctgaaccaccttctaatcaagacgtgattcgcccttggaataatcctatgtatgctcaaggacacttggctattttaaaaggaaatttggcgacagagggagcagttgctaaaattacaggagtgaagaacccagaaataacaggactagcaagagtatttgattcggaagaagcttgtttagaagcaatattagcagggaaaattcaagcagggaatattattgtagttcgctatgaaggtccaaaaggtggaccaggtatgcgagaaatgttagcaccaacttcggctattattggtgctggtttgggggataaagtgggattaattactgatggtaggttttctggtggtacttatggtatggtggttggtcatgtagctccagaagctgcagtaggtggcacgatcgctctagttaaggaaggagatatgattactattgatgctcataagcgtttactacagttaaatatttctgatgaggaattagaaaagcgtcgtcaagtatggaaaccacgaaaaccccaatatactagaggtgtattagctaaatatgctaagttagtttcttctagcagtgttggagcagtaactgacgctggattaggttga

SEQ ID NO: 292 - protein, 561 aa, Trichodesmium erythraeum
MPENLRSQLVTKGVQRAPNRAMLRAVGFEDSDFTKPIIGVANAHSTITPCNMGINDLAMRAVSGVKEAGGMPQIFGTITISDGISMGTEGMKYSLVSRDVIADSIETVCNGQTMDGVLAIGGCDKNMPGAMIAIARMNIPAIFVYGGTIKPGNYNGKDLTVVSAFEAVGEYSAGKIDETELTEVERRACPGAGSCGGMFTANTMSSAFEAMGMSLMYSSTMAAEDAEKADSTEKSAHVLVEAIRKQILPSQIITRKAIENAISVIMAVGGSTNAVLHLLAIAYAANVKLSLDDFEIIRARVPVLCDLKPSGKYVTTNLHQAGGIPLVMKMLLEHDLLHPDALTITGKTIGEQLTNIPSEPPSNQDVIRPWNNPMYAQGHLAILKGNLATEGAVAKITGVKNPEITGLARVFDSEEACLEAILAGKIQAGNIIVVRYEGPKGGPGMREMLAPTSAIIGAGLGDKVGLITDGRFSGGTYGMVVGHVAPEAAVGGTIALVKEGDMITIDAHKRLLQLNISDEELEKRRQVWKPRKPQYTRGVLAKYAKLVSSSSVGAVTDAGLG

SEQ ID NO: 293 - DNA, 1686 bp, Acaryochloris marin
atgtctgacaatcgaaatagccaagtcgtcactcaaggagttcaacgagcccccaaccgggccatgctaagggctgtgggctttggagatgatgattttaccaagccgattgttgggttagcgaatggttttagtacgattaccccttgtaatatgggcatagactctctggctacacgggcagaggccagtatcagaacggctggagccatgccgcaaaagtttggcaccatcactatcagtgacggcatttccatgggcacggaagggatgaaatattccttggtgtcccgggaagtgattgcagactccatcgagacggcctgtatgggccaaagtatggatggagtactcgccattggcggctgtgataaaaatatgccgggggctatgctcgccatggctcggatgaatattccggccatctttgtttacggcggcacgatcaaacccggacatctaaatggtgaagacttaaccgtggttagtgcctttgaagctgtgggtcagcatagtgctggacggattagtgaagccgagttaacggcagtggagaaacatgcttgtccgggtgctggatcctgtggcggtatgtatacggccaacaccatgtcttctgcgtttgaggcaatgggcatgagcctgatgtattcttccaccatggcagcggaagatgaagaaaaagccgtcagtgcagaacagtctgccgctgttttagtggaagcgatccacaagcaaattctgccccgcgatatcttgacccgcaaagcctttgaaaatgccattgctgtgattatggctgtaggcggatccaccaatgccgttctccacctgttggccatttcccgcgcggctggagactccctgaccctagatgacttcgaaaccatccgggctcaagttccagtgatctgcgatctcaaaccatcaggtcgctatgtagccacagatctccataaagcaggtggaatcccattggtgatgaaaatgctattggaacatggtcttctccatggtgatgctctgaccattacgggtaaaaccattgctgagcagttggctgatgtcccatcagagccttcccccgatcaggatgtaattcggccttgggacaatcccatgtataaacaaggccacctcgccatcctccggggtaacttggccacggaaggagcggttgccaaaatcacaggcattaaaaatccccaaattacgggtccagctcgggtatttgaatcggaagaggcttgcttggaggcgattttggcaggcaagattcagcctaatgatgtgattgtggtgcggtatgaaggcccgaagggtgggccgggaatgcgagagatgttagctcccacgtccgcgattattggggcaggtttgggtgattcagttggattgattacggatggtcgcttttctggtggaacttacggcatggtggttgggcatgtggccccagaagctgcggtgggtggtacgattgcccttgtgcaggaaggcgatcagattacaattgatgcccatgctcgaaagttggagctgcatgtgtctgatcaggagttaaaagagcggaaggagaagtgggagcaaccaaaacctctctataacaaaggggttttggcaaagtatgccaagttagtttcttctagtagtgttggagctgttactgatttagatctattttga

SEQ ID NO: 294 - protein, 561 aa, Acaryochloris marin
MSDNRNSQVVTQGVQRAPNRAMLRAVGFGDDDFTKPIVGLANGFSTITPCNMGIDSLATRAEASIRTAGAMPQKFGTITISDGISMGTEGMKYSLVSREVIADSIETACMGQSMDGVLAIGGCDKNMPGAMLAMARMNIPAIFVYGGTIKPGHLNGEDLTVVSAFEAVGQHSAGRISEAELTAVEKHACPGAGSCGGMYTANTMSSAFEAMGMSLMYSSTMAAEDEEKAVSAEQSAAVLVEAIHKQILPRDILTRKAFENAIAVIMAVGGSTNAVLHLLAISRAAGDSLTLDDFETIRAQVPVICDLKPSGRYVATDLHKAGGIPLVMKMLLEHGLLHGDALTITGKTIAEQLADVPSEPSPDQDVIRPWDNPMYKQGHLAILRGNLATEGAVAKITGIKNPQITGPARVFESEEACLEAILAGKIQPNDVIVVRYEGPKGGPGMREMLAPTSAIIGAGLGDSVGLITDGRFSGGTYGMVVGHVAPEAAVGGTIALVQEGDQITIDAHARKLELHVSDQELKERKEKWEQPKPLYNKGVLAKYAKLVSSSSVGAVTDLDLF

SEQ ID NO: 295 - DNA, 1683 bp, Lyngbya sp.
atgtcagataactttagaagtcaagccatcacccaaggaaagaaacgcacaccgaaccgggcgatgctccgagcggtagggtttggggatgaggactttaataagcctattgtcggcattgctaatggttacagtaccattactccctgcaacattggattgaacgatttggcgcatcgtgctgaaacggcattaaaacaagccgacgctatgcctcaaatgtttgggacgattactgttagtgatggcattgccatgggaaccgaggggatgaaatattctctggtttcccgagaggtgatcgccgatgcgattgaaactgcttgtaatgggcagagtatggatggcgttttggcgattggcggttgtgataaaaatatgcctggggcgatgattgcgatcgcgaggatgaatattccggcaatttttgtgtatggcggtacgattaaaccggggaatttaaacggttgtgatttaacggttgtcagtgcgtttgaggctgtcggcgaatacagcgccgggaaacttgatgatgatcgcttactcgatattgaacgccttgcttgtccgggttcggggtcttgtgggggaatgtttacggcaaatactatgtcttcggcgtttgaagcgatggggatgagtttaatgtattcttccacaatggcttctgaagatgcggaaaaggctgatagtaccgaaaagtctgcgtttgtgttgcgtgaggcgattagtcaacggattttaccgaagcaaattctcacccgcaaggcgtttgaaaatgcgatcgctgtgattatggcggtgggcggttcgacaaactcggtattacacttgttggcgattgcttatgcagcagatgtggaactgacgattgatgattttgaaacaattcggggacgggttccggttttatgtgatcttaaacccagtgggcgatttgtcacgacggattttcacaaagcgggtggcgttccgctgattatgaaaatgcttctcgaacagggtttaattcatggtgatgctttaacgattaccgggaaaacggttgccgaacagttggctgatattccctctcaaccgtctgcggatcaagaggtgattcgcccctggaataatccgatgtacaagcaagggcatttagcgattttgaagggaaatctcgccacagaaggcagtgttgctaaaattacaggcgtgaaaaaaccgcaaatgactggccccgcacgggtatttgagtcggaagaacagtgtttagaggcgattttagcgggtaaaattcaagctggagatgttttggtggttcgctatgaaggccccaaaggtggccccggaatgcgagaaatgttggcgccgacttccgcaattattggggcaggcttaggggattctgtgggcttgattaccgatggacggttttcggggggaacttatggcttggttgtcggtcatgttgccccagaagctgccgttggtggtaatattgcgttggttcaagagggcgatagtattacgattgatgcttcacaacggttattgcaggtgaatatttctgatcaggtattggaacaacgccgtcaaaattggcaaccgcctcaacctcgttacacaaaaggtgttttagctaaatatgcgaagttagtgtcttcgagtagtgtgggggcggtgacggatttagactgttaa

SEQ ID NO: 296 - protein, 560 aa, Lyngbya sp.
MSDNFRSQAITQGKKRTPNRAMLRAVGFGDEDFNKPIVGIANGYSTITPCNIGLNDLAHRAETALKQADAMPQMFGTITVSDGIAMGTEGMKYSLVSREVIADAIETACNGQSMDGVLAIGGCDKNMPGAMIAIARMNIPAIFVYGGTIKPGNLNGCDLTVVSAFEAVGEYSAGKLDDDRLLDIERLACPGSGSCGGMFTANTMSSAFEAMGMSLMYSSTMASEDAEKADSTEKSAFVLREAISQRILPKQILTRKAFENAIAVIMAVGGSTNSVLHLLAIAYAADVELTIDDFETIRGRVPVLCDLKPSGRFVTTDFHKAGGVPLIMKMLLEQGLIHGDALTITGKTVAEQLADIPSQPSADQEVIRPWNNPMYKQGHLAILKGNLATEGSVAKITGVKKPQMTGPARVFESEEQCLEAILAGKIQAGDVLVVRYEGPKGGPGMREMLAPTSAIIGAGLGDSVGLITDGRFSGGTYGLVVGHVAPEAAVGGNIALVQEGDSITIDASQRLLQVNISDQVLEQRRQNWQPPQPRYTKGVLAKYAKLVSSSSVGAVTDLDC

SEQ ID NO: 297 - DNA, 1686 bp, Synechocystis sp.
atgtccaacaatcccagaagccaggtaattacccagggcacccaacggagtcccaaccgggccatgctccgggccgttggttttggcgatgatgactttacgaaacccattgtgggtattgccaacgggtacagcaccattaccccctgcaacatgggcattaatgatctggctctacgggccgaggccggcttacggacagcgggggccatgccccaattgtttggcactatcaccatcagtgacggtatttccatgggtacggaagggatgaaatattccctagtttcccgggaagtgattgctgattccatcgaaacagtatgcaatggccaacgcatggacggagttttggcgatcgggggctgtgataagaatatgccgggggcaatgattgccatggctcgcctcaatattccctctatctttgtttacggtggcactattaaacccggacattatgccggggaagatttaacagtggtcagtgcctttgaagcggtgggccagtacagcgctggcaaaattgatgaggaaaccctctacggcattgaacggaatgcctgtcctggggctggttcctgtggggggatgttcaccgccaacaccatgtcctccgcctttgaagctatggggatgagcttgccctattcttctaccatggccgcagtggatggggaaaaagccgacagcaccgaggagtccgccaaggttttggtggaagccatcaaaaaacagattttgcccagtcaaattctgacccggaaagcttttgaaaatgccattgccgtgattatggccgtggggggctccactaatgcagtgctccatctgctggcgatcgccaacaccattggggtgcccctaagcttggacgattttgaaaccattcgccacaaagtacctgtactgtgcgacctcaaaccttccggcaaatacgtcaccactaatctccacgccgccggtggcattccccaggtgatgaaaatattgctggtcaatggcattctccacggtgacgctttaacgattacaggacagaccattgctgaagttttagccgatattcctgaccaaccccctgccggccaggacgtaatccattcctgggatgaccctgtttatcaagaaggtcacctggcagtgctcaaaggtaacctggccaccgaaggcagtgtggctaaaatcagcggtgttaaaaagccggtgatcactggtcccgccaaagtatttgaatctgaagaagattgcctagaagcgattctagccggcaaaattcaagcaggagatgtggtggtcgtgcgctatgaagggcccaaaggtggccccggtatgcgggaaatgctagcccccacttctgccatcattggggcagggttgggagactccgttggcctaatcaccgatggccgcttttctggtggtacctatggcttagtggtgggtcacgttgcccccgaagcttatgtgggaggggcgatcgccttggtgcaagagggggatcaaatcaccatcgatgctggcaagcggttactgcaactcaacatcagtgaagaggaattggcccaacggcgggcccaatggactcctcctcagccccgctatccccgggggattttagccaagtatgccaagttagtttcctccagcagccttggtgcagtgactgatatagacttgttctaa

SEQ ID NO: 298 - protein, 561 aa, Synechocystis sp.
MSNNPRSQVITQGTQRSPNRAMLRAVGFGDDDFTKPIVGIANGYSTITPCNMGINDLALRAEAGLRTAGAMPQLFGTITISDGISMGTEGMKYSLVSREVIADSIETVCNGQRMDGVLAIGGCDKNMPGAMIAMARLNIPSIFVYGGTIKPGHYAGEDLTVVSAFEAVGQYSAGKIDEETLYGIERNACPGAGSCGGMFTANTMSSAFEAMGMSLPYSSTMAAVDGEKADSTEESAKVLVEAIKKQILPSQILTRKAFENAIAVIMAVGGSTNAVLHLLAIANTIGVPLSLDDFETIRHKVPVLCDLKPSGKYVTTNLHAAGGIPQVMKILLVNGILHGDALTITGQTIAEVLADIPDQPPAGQDVIHSWDDPVYQEGHLAVLKGNLATEGSVAKISGVKKPVITGPAKVFESEEDCLEAILAGKIQAGDVVVVRYEGPKGGPGMREMLAPTSAIIGAGLGDSVGLITDGRFSGGTYGLVVGHVAPEAYVGGAIALVQEGDQITIDAGKRLLQLNISEEELAQRRAQWTPPQPRYPRGILAKYAKLVSSSSLGAVTDIDLF

SEQ ID NO: 299 - DNA, 1686 bp, Cyanothece sp.
atgtctgagaatgcaagaagtcgcctcattaccgagggaagtcaacgaacccctaaccgtgccatgttgcgtgctgtgggcttcggagatgatgattttaataagcctattgttggggtagctaatggcttcagtaccataaccccttgtaacatggggattaatgacctagctaaacgtgctgaagcaggaattaaaaccgctggtgggatgcctcagatattcggtaccattaccatcagtgatggcatttctatgggaaccgaaggcatgaaatattccctcgtctcacgggatgttattgccgactctatcgaaaccgtttgtaatggtcaaagcatggatggagtgatcgctattggtggatgcgacaagaatatgccaggggcaatgatagccatggcaagaatgaatatacctgcaatctttgtctatggaggaaccattaaacccggccattacaacggggaagatttaacagtagtcagtgcctttgaagcggtcggccaacatagtgcaggtaagatagatgatagcacattattggctattgaacgtaatgcttgccccggtgccggttcctgtgggggaatgttcaccgcaaataccatgtcttcagcgtttgaagtgatgggaatgagtttaccttattcttctacgatggcagcagaagatgcagaaaaagcagacagtacagaaaagtcagcttttgctttagttaatgccattcgtaaccagattttacccagtcacattttaacccgaaaagcctttgaaaatgccatttctgtaatcatggcggtgggaggttctacgaatgctgtattacaccttttagcgatcgctaataccatcggtgttgacctaactttagacgattttgaaaccattcgtcaacgggttcctgtactctgtgatttaaaaccatcgggacgctatgtaacggttaatttgcatgaagcgggtggcattcctcaagtgatgaaactattattaaatcatggattattacatggggatgcgttaacgatttccggtcaaactatagcagaaattttagccgatgtaccggatgaacctccagcgaatcaagatgttattcggacttgggataaccctgtttataaagagggacatttagccattttaaaaggtaatttagcctctgagggtgcagttgccaaaattagtggggtaaagaatcccaaaataacaggtccggcgcgagtttttgagtcggaagaggaatgtttagaggcaattttagcaggaaaaattaacgctggtgatgtcattattgtccgttatgaaggtcctagaggaggcccaggaatgcgagaaatgttagcaccaacttctgcaattattggggctggtttaggtgattccgtgggcttaattaccgatggccggttttctgggggaacctatggtttagtggtgggtcatgttgccccagaagcttacgtagggggtactattggcttagtaaaagaaggggatagtattaccattgatgctaaagaaaaactccttcaagtcaatgtttctgaagaagaattaaaccaacgtcgggctaattggaaagctcccgaacctcgttataaaagaggggtattaggtaagtatgccaagttagtttcttctagtagtttaggggcagttactgacgtgaatttgttttaa

SEQ ID NO: 300 - protein, 561 aa, Cyanothece sp.
MSENARSRLITEGSQRTPNRAMLRAVGFGDDDFNKPIVGVANGFSTITPCNMGINDLAKRAEAGIKTAGGMPQIFGTITISDGISMGTEGMKYSLVSRDVIADSIETVCNGQSMDGVIAIGGCDKNMPGAMIAMARMNIPAIFVYGGTIKPGHYNGEDLTVVSAFEAVGQHSAGKIDDSTLLAIERNACPGAGSCGGMFTANTMSSAFEVMGMSLPYSSTMAAEDAEKADSTEKSAFALVNAIRNQILPSHILTRKAFENAISVIMAVGGSTNAVLHLLAIANTIGVDLTLDDFETIRQRVPVLCDLKPSGRYVTVNLHEAGGIPQVMKLLLNHGLLHGDALTISGQTIAEILADVPDEPPANQDVIRTWDNPVYKEGHLAILKGNLASEGAVAKISGVKNPKITGPARVFESEEECLEAILAGKINAGDVIIVRYEGPRGGPGMREMLAPTSAIIGAGLGDSVGLITDGRFSGGTYGLVVGHVAPEAYVGGTIGLVKEGDSITIDAKEKLLQVNVSEEELNQRRANWKAPEPRYKRGVLGKYAKLVSSSSLGAVTDVNLF

SEQ ID NO: 301 - DNA, 1683 bp, Thermosynechococcus elongatus
atggcagaaaattggcgcagtcgcatcatcacagaaggcattcaacgcacccccaaccgagccatgctgcgagccgtgggttttggtgacgaggattttaacaagcccattgtgggggtggccagtgcccacagcacaattacgccctgcaacatggggattgctgcccttgccagtcgcgccgaagcaggaattcgggccgcgggagggatgccgcaattgtttggcaccattacggtcagcgatggtatttccatgggcactgaagggatgaaatactctttggtctcgcgggatgtgattgctgattcgattgagactgtctgtaatgcccagagtatggatggggtgctggcgatcggtggctgtgacaagaatatgcctggcgccatgattgccatggcacggatgaacattccagccatttttgtctatgggggtacgattaagcccggtcattggcaggggcaagaccttacggttgtcagcgcctttgaggccgtaggtcagtttagtgccggcaaaatggatgaggcaacgctccatgccattgaacaccatgcctgtccgggggcgggctcctgtggcgggatgttcacagccaatacgatgtcctcggcctttgaggccatgggcatgagtttaatgtattcctcaacgatgacggcggaagatgccgaaaaagctgacagcactgagttggcgggcaaggtgctggtggaggcaatccgcaaaaatattcgcccccgtgacattattacccgcaaatccattgaaaatgccatcagtgtgattatggctgtggggggatccacaaatgccgtgctgcattttctggcgatcgcccacagtgccgaggttcccttgaccattgatgattttgaaacgattcgccagcgggtgcccgttctctgcgacctcaagccctcgggtaaatacgtcactgcggatctacatcgggcagggggcattccccaagtcatgaaaatgctcctcaatgccggattgctccacggggattgcctaacgattactggagaaaccattgccgagcggctgcggcatgtgcccgatacccccgaccccaaccaagatgtgattcgtccttttgatcaacccttgtatgccacgggtcacctggctattctcaagggcaatctagccagcgaaggtgctgtagccaaaatctccggggtgaaaaatccccaaattaccgggcctgcccgcgtctttgactccgaggaagactgccttgacgccattctggcgggcaagatcaaccccggcgatgtcattgtcattcgctatgaaggccccgtcggcggtccggggatgcgggaaatgctggctcccacctctgccattattggtgcgggtttaggggatagtgttggcctcattaccgatggtcgcttttccggaggcacctatggcatggtcgtcggtcatgtggcgccggaagcggcagttggtgggacgatcgcccttgtgcaggagggagattcgattaccattgacgcccatcggcggctcctacaactgaatgtcagtgaggaagaactggcggcgcggcgggctaaatggcagccccctgcccctcgctacacccgtggtgtcttggctaaatatgccaaactagtgtcctctagtagtctgggagcggtgacggatcgctttgtctag

SEQ ID NO: 302 - protein, 560 aa, Thermosynechococcus elongatus
MAENWRSRIITEGIQRTPNRAMLRAVGFGDEDFNKPIVGVASAHSTITPCNMGIAALASRAEAGIRAAGGMPQLFGTITVSDGISMGTEGMKYSLVSRDVIADSIETVCNAQSMDGVLAIGGCDKNMPGAMIAMARMNIPAIFVYGGTIKPGHWQGQDLTVVSAFEAVGQFSAGKMDEATLHAIEHHACPGAGSCGGMFTANTMSSAFEAMGMSLMYSSTMTAEDAEKADSTELAGKVLVEAIRKNIRPRDIITRKSIENAISVIMAVGGSTNAVLHFLAIAHSAEVPLTIDDFETIRQRVPVLCDLKPSGKYVTADLHRAGGIPQVMKMLLNAGLLHGDCLTITGETIAERLRHVPDTPDPNQDVIRPFDQPLYATGHLAILKGNLASEGAVAKISGVKNPQITGPARVFDSEEDCLDAILAGKINPGDVIVIRYEGPVGGPGMREMLAPTSAIIGAGLGDSVGLITDGRFSGGTYGMVVGHVAPEAAVGGTIALVQEGDSITIDAHRRLLQLNVSEEELAARRAKWQPPAPRYTRGVLAKYAKLVSSSSLGAVTDRFV

SEQ ID NO: 303 - DNA, 1698 bp, Synechococcus sp.
atggccaattcccctttcccgctgcgcagccaagtggttacccagggagtacagcgctcccccaaccgcgccatgctcagggccgtaggctttcgcgacgaagacttcggcaagcccattgtcggcattgccaacgcccacagcaccctcaccccctgcaacatggggatccaaactctggcggagcgggcggaggcggctttgagaacggcgggctgtatgccccaggtgttcggcaccatcaccattagcgacggcatctcgatgggcacggaggggatgaaatactccctggtgtcgcgggaagtgattgccgattccatcgagacggtggtcaacggccagagcatggatggcctcttggccattggcggctgcgacaagaacatgccgggggcgatgatcgccatggcccgcctcaatgtgccctccatcttcgtctacggcggcaccatcaagccgggtcactacaatggccgcgacctcaccatcgtcagcgcctttgaagcggtgggggagttcagtgccgggcgcatctccgaggaagagctgctggcggtggagcgccatgcctgtcccggtgccggatcctgcggcggcatgtacacggccaacaccatgtccagcgcgtttgaggctatggggatgagtctgccctactcctccaccatggctgcagaagacgaagagaaagccgaaagtgccgcccaatcggccaaggtcttggcagaggccatcaaagccaacatccgcccccgcgacatcatcacccgtaaaagcattgaaaatgccatctcggtgatcatggccgtagggggatccaccaacgccgtgctccactttctggccattgcccatgcggcagaagtgcccctgacgctagatgatttcgagaccattcgtgctcgcgtgcctgtcctctgcgatctcaagccttcagggcggtttgtggccaccgacctgcaccgggccggtgggatcccccaggtgatgaaaatgctgctcaaccacggcctgctgcacggggactgcctcaccatctccggccagaccatcgtcgaagtcctgcgggatgtgccggacgagcctagcccggatcaggaggtgatccgcccttggcacagccccctgtatccccaagggcatctggccatcctcaaggggaatctggctcccgaaggagcagtagccaagattaccggcgtcaagaacccgcaaattaccgggccggcgcgggtcttcgattcagaggagtcctgcctgcaggccatcctctccggccagatccgagcaggggatgtggtggtgatccgctacgaaggccccaaaggtggccccggcatgcgggagatgctctcgcccacttcggccatcatcggcgccggcttgggggatagcgttggcctgatcaccgatggccgcttctccggcggcacctacggcatggtagtgggccatgtggctcccgaagcctatgtggggggcacgattgccctggtggaggaaggggatctcatcaccattgatgccccggctcgccagttgcacttgcatgtgagcgaagaagagctggcccgccgccgcgcccgctggtctcctcctgagcctcgctacaaacggggcaccctagccaagtacgccaagctggtctccagcagcagcctgggggcagtgacggatttaaacctgtgggattaa

SEQ ID NO: 304 - protein, 565 aa, Synechococcus sp.
MANSPFPLRSQVVTQGVQRSPNRAMLRAVGFRDEDFGKPIVGIANAHSTLTPCNMGIQTLAERAEAALRTAGCMPQVFGTITISDGISMGTEGMKYSLVSREVIADSIETVVNGQSMDGLLAIGGCDKNMPGAMIAMARLNVPSIFVYGGTIKPGHYNGRDLTIVSAFEAVGEFSAGRISEEELLAVERHACPGAGSCGGMYTANTMSSAFEAMGMSLPYSSTMAAEDEEKAESAAQSAKVLAEAIKANIRPRDIITRKSIENAISVIMAVGGSTNAVLHFLAIAHAAEVPLTLDDFETIRARVPVLCDLKPSGRFVATDLHRAGGIPQVMKMLLNHGLLHGDCLTISGQTIVEVLRDVPDEPSPDQEVIRPWHSPLYPQGHLAILKGNLAPEGAVAKITGVKNPQITGPARVFDSEESCLQAILSGQIRAGDVVVIRYEGPKGGPGMREMLSPTSAIIGAGLGDSVGLITDGRFSGGTYGMVVGHVAPEAYVGGTIALVEEGDLITIDAPARQLHLHVSEEELARRRARWSPPEPRYKRGTLAKYAKLVSSSSLGAVTDLNLWD

SEQ ID NO: 305 - DNA, 1683 bp, Gloeobacter violaceus
atgtccggcaatctgcgcagccgcatcgtcacccagggggtgcagcgctcccccaaccgcgccatgctgcgggcggtgggttttggcgacggtgatttcgagcggcccatcgtgggggtggccaacggcttcagcacgattaccccctgcaatctgggcctgggagctttggcggagcgggcggaggcggcgttgcgcgccggcggggcgatgccccaactattcggaacgatcacgatcagcgacggcatctcgatgggtaccgaggggatgaagtactcgctggtgtcccgcgaggtgatcgccgacagcatcgagacggtctgcaacggtcagagcctggacggggtgctcgctatcggcggctgcgacaagaacatgccgggtgcgatgatcgccattgccagactcaatatcccggcggtcttcgtctacggcggcacgatcaaacccggccgctaccaggatcaggacctcacggtcgtgagcgccttcgaagcggtgggccagtacagcgccggcaaaattgaccagacgaccctcgtcgaaatcgagcggcgcgcctgcccgggggcgggctcctgcggcggcatgtacaccgccaatacgatgagttcggccttcgaggcgatgggcatgagcttggtgtactcctcgacgatggccgccgaggatcccgaaaaagcggacagcaccgccctgtcggccaaggtgctggttgaagcgatccaagcgcaaatcctgccgagcgccatcctgacgcgaaaagctttcgagaacgccatcgctgtgatcatggccatcggcggctcgaccaacgccgtgctgcacctgcttgccatcgcccacagcgcccgggtgccactcgcactggatgacttcgagtgcatccgcgcgcgggtgccggtgctgtgcgatctcaagcccagcggtcgctttgtcgccaccgatctgcacagagccgggggtattccccaggtgatgaaaatgttgctcgtgcgcgggctcctccacggcgacgccctcacggtaaccggccagacggtcgccgaggtgctgcgcgacgtacccacagaaccgcgcaccgaccaggaggtgatccgtccctgggaccggcctctctacagttcggggcacctggccattttgcgcggcaacctggcgagcgaaggggcggtcgccaagattaccggcgtcaaaaagccccagatcactggtcctgcccgcgtcttcgactccgaagaaagctgcatggaagcaattctggcgggcgccatccagccgggcgatgtgatcgtcattcgctacgaaggccccaagggcggtcccggcatgcgggagatgctctcgcccacttcggccatcatcggcgcgggtctgggcgatgcggtgggactgatcaccgacggccgcttctcggggggcacctacggcatggtcgtgggccacgtcgccccggaagccttcgtgggcggcaccatcgccctggtcgaagcaggagatctgatcaccatcgacgccccggcgcgcaagatcgagctattggtgaccacagacgaactggagcgccgacgcgccgcctggcggccgcctgccccccgttacatccgcggggtgctcgccaagtacgcccgtcaggtgaacagcagcagcctcggggcggtcaccgacgcctttatttga

SEQ ID NO: 306 - protein, 560 aa, Gloeobacter violaceus
MSGNLRSRIVTQGVQRSPNRAMLRAVGFGDGDFERPIVGVANGFSTITPCNLGLGALAERAEAALRAGGAMPQLFGTITISDGISMGTEGMKYSLVSREVIADSIETVCNGQSLDGVLAIGGCDKNMPGAMIAIARLNIPAVFVYGGTIKPGRYQDQDLTVVSAFEAVGQYSAGKIDQTTLVEIERRACPGAGSCGGMYTANTMSSAFEAMGMSLVYSSTMAAEDPEKADSTALSAKVLVEAIQAQILPSAILTRKAFENAIAVIMAIGGSTNAVLHLLAIAHSARVPLALDDFECIRARVPVLCDLKPSGRFVATDLHRAGGIPQVMKMLLVRGLLHGDALTVTGQTVAEVLRDVPTEPRTDQEVIRPWDRPLYSSGHLAILRGNLASEGAVAKITGVKKPQITGPARVFDSEESCMEAILAGAIQPGDVIVIRYEGPKGGPGMREMLSPTSAIIGAGLGDAVGLITDGRFSGGTYGMVVGHVAPEAFVGGTIALVEAGDLITIDAPARKIELLVTTDELERRRAAWRPPAPRYIRGVLAKYARQVNSSSLGAVTDAFI

SEQ ID NO: 307 - DNA, 1674 bp, Nitrosomonas eutropha
atgccagacaatcgacgcagccaggccatcactaaaggtgcgaaacgtgctcccaatcgcgccatgttacgtgcagttggattcggtgacggagatttcgataagcccattgtcggcattgccaacggcttttccaccatcacgccttgcaacatggggctggatacgcttgccaaatgtgcggaacatgcattgaaaaatgccggtgccatgccgcaaatgttcggcacgattacggtatcggatggtatctccatgggcaccgaaggcatgaaatactcactggtatcacgcgaggtaatcgctgattccattgaaacctgcgtgcaggcggaaagcatggatggcgtcattgccattggcgggtgtgacaaaaacatgcctggtgccctaatcgcgctggctagactgaacgtgccatccatttttgtctatggcggcaccatcaagcccggtcactaccagggtcgcgatctgacaatcgtcagtgcgtttgaagcggttgggcaacatagcgcacacaagattgatgatcaggaactgctggaagttgaacgccatgcctgtcccggcgcaggttcgtgcggcggcatgtacaccgccaacaccatgtcctctgcgattgaggcgatgggcatgagtctgccccattcctccactatggctgcggaagatgaggaaaagcggatcagcgccacccgctctgccgaggtgctggtggaagcaatcaaaaaacagattctgccgcgcagcctgattacccgcaagtcactcgaaaatgcagtaacggtagtcatggccgtaggcggctcgaccaatgctgtgctgcatctgctggccatcgcccacgcagcagaagtagattttcatattgacgatttcgaagcgattcgtgcccgtgtgccggtgttgtgtgacctgaaaccttccgggcgctacgtcgccactgatctgcacagagcaggcggcattccacaagtgatgaaaatgctgctcgtgcacggtctgctgcatggtgactgtctgaccatcagcggacaaactatcgctgaagtactgaaagatattcctgaacaaccgcgcgcggatcaaaacgtcatccgcacctgggacaacccggtgtatgaacaaggtcatctggcgatcctgaagggtaatctttcgccggaaggtgcggtggccaagatttccggtgtaaaaaaccccaatattaccgggcccgccagagtgtttgaatccgaagaaacctgtatgactgccattctcgatcgcaaaatcaagccgggtgatgttgtcgttattcgctacgaggggccacgcggcggtcccggcatgcgtgaaatgctctcccctacttcggcgctaatcggtgaaggattgggtgattcggtcggattgattaccgatggccgtttttccggcggcacctacggcatggtcgtaggccatgtagcaccggaagcatacgccgggggagtgatcgctctggtggaagaaggagattcaatcacaatcgatgcgcatcgccgcctgttacaactgaatgtttcagaaacagaattggaacgccgccgggctgcctggcagccgcctgcgccgcgctacacacgcggtgtactggcaaaatatgccaaactggtatcaaccgccagtcgtggtgcggttactgattaa

SEQ ID NO: 308 - protein, 557 aa, Nitrosomonas eutropha
MPDNRRSQAITKGAKRAPNRAMLRAVGFGDGDFDKPIVGIANGFSTITPCNMGLDTLAKCAEHALKNAGAMPQMFGTITVSDGISMGTEGMKYSLVSREVIADSIETCVQAESMDGVIAIGGCDKNMPGALIALARLNVPSIFVYGGTIKPGHYQGRDLTIVSAFEAVGQHSAHKIDDQELLEVERHACPGAGSCGGMYTANTMSSAIEAMGMSLPHSSTMAAEDEEKRISATRSAEVLVEAIKKQILPRSLITRKSLENAVTVVMAVGGSTNAVLHLLAIAHAAEVDFHIDDFEAIRARVPVLCDLKPSGRYVATDLHRAGGIPQVMKMLLVHGLLHGDCLTISGQTIAEVLKDIPEQPRADQNVIRTWDNPVYEQGHLAILKGNLSPEGAVAKISGVKNPNITGPARVFESEETCMTAILDRKIKPGDVVVIRYEGPRGGPGMREMLSPTSALIGEGLGDSVGLITDGRFSGGTYGMVVGHVAPEAYAGGVIALVEEGDSITIDAHRRLLQLNVSETELERRRAAWQPPAPRYTRGVLAKYAKLVSTASRGAVTD

SEQ ID NO: 309 - DNA, 1674 bp, Nitrosomonas europaea
atgccagataatcgacgcagccaaaccattacccaaggtgcacaacgcacccccaaccgcgccatgttacgcgcagtcggtttcggtgacggagacttcgataaacctatcgtcggggttgccaacggtttttccaccatcacaccctgcaacatggggctggatacccttgccaaatgcgccgaacatgcgctgaaaaccgccggtgccatgccgcagatgtttggcaccatcaccgtatccgacgggatctccatgggtaccgaaggcatgaagtattctctggtttcgcgcgaagtgatcgccgattcgatcgaaacctgcgtacaggcggaaagtatggatggcgtcatcgccatcggtggttgcgataaaaacatgcctggcgccatgatcgcgctggccagactgaacgtaccgtccatcttcgtctatggcggtaccatcaaacctggccattaccagggccgtgatctgaccatcgtaagcgctttcgaagctgtcggacagcataccgcgcacaagatagacgatcatgaactgctggaagtcgaacgccatgcctgtcccggcgccggttcgtgcggtggtatgtacacagccaacaccatgtcatctgccatcgaggcaatgggaatgagcctgccttactcttccaccatggcagcagaagatgaggaaaaacggatcagcgccatacgctccgccgaagtactggtggacgcggtcaaaaagcagattctgccgcgcagcctgatcacccgcaaatccatcgaaaatgcggtatctgtcgtcatggcggtgggaggttcgaccaatgccgtgctgcacctgctggccatcgcccatgcagccgaagtggaattcagcatcgatgatttcgaagccattcgtgcacgcgtaccggtattgtgcgatctgaaaccttccggacgctatgtagccacggatctgcacaaagcgggcggtattccgcaagtgatgaaaatgttgctggtacacgacctgctgcacggcgactgtctgaccatcagcggacaaaccatcgcggaagtgctgaaagacattcccgaacagccgcgtgccgatcaggatgtgattcaaccctgggacaatccggtatatgaacaggggcacctggcgatcctgaaaggtaatctttcatcagaaggtgcggttgccaagatttccggcatcaaaaatcccagtattaccggtcccgccagagtgttcgattctgaagaaacctgcatggctgccattcttgaacgcaaaatccagccaggtgatgtggtggtcatccgctacgaaggcccacagggcggacccggcatgcgcgaaatgctttctcccacttcagcactgatcggtgaagggctgggtgattcggtcgggttgattaccgatgggcgtttctccggtggtacctacggaatggtggtgggccatgtggcaccggaagcattcgccggcggaacgatcgccctggtacaagagggagattcgattacgatcgatgcacaccgtcgcctgctgcaactgaatgttcctgaagccgagctggaacgccgccgggcagcctggcatccacctgcaccacgctacacacgcggcgtactggcgaaatacgccaagctggtatccactgccagccgtggtgcagtcaccgattaa

SEQ ID NO: 310 - protein, 557 aa, Nitrosomonas europaea
MPDNRRSQTITQGAQRTPNRAMLRAVGFGDGDFDKPIVGVANGFSTITPCNMGLDTLAKCAEHALKTAGAMPQMFGTITVSDGISMGTEGMKYSLVSREVIADSIETCVQAESMDGVIAIGGCDKNMPGAMIALARLNVPSIFVYGGTIKPGHYQGRDLTIVSAFEAVGQHTAHKIDDHELLEVERHACPGAGSCGGMYTANTMSSAIEAMGMSLPYSSTMAAEDEEKRISAIRSAEVLVDAVKKQILPRSLITRKSIENAVSVVMAVGGSTNAVLHLLAIAHAAEVEFSIDDFEAIRARVPVLCDLKPSGRYVATDLHKAGGIPQVMKMLLVHDLLHGDCLTISGQTIAEVLKDIPEQPRADQDVIQPWDNPVYEQGHLAILKGNLSSEGAVAKISGIKNPSITGPARVFDSEETCMAAILERKIQPGDVVVIRYEGPQGGPGMREMLSPTSALIGEGLGDSVGLITDGRFSGGTYGMVVGHVAPEAFAGGTIALVQEGDSITIDAHRRLLQLNVPEAELERRRAAWHPPAPRYTRGVLAKYAKLVSTASRGAVTD

SEQ ID NO: 311 - DNA, 1674 bp, Nitrosospira multiformis
atgtcagataaccagcgcagccgggcaatcacccagggggcggaacgtacccccaaccgcgcgatgctgcgggccgtaggtttcagcgacaacgatttcgacaaaccaatcgtcggcgtggccaatggcttttccaccatcacaccctgcaacaagggattgaacgaactggcgctggctgccgagcaggcattgaaacaggcggctgcgatgccccagatgttcggtaccatcaccgtttccgatggcatctccatgggaacggagggcatgaagtattcactggtatcccgcgaagtcattgccgactcgatcgaaacggcggtgcaggccgaaagcatggatggcgtgatcgccatcgggggctgtgacaagaacatgccaggagcaatgatcgccattgcgcgcatgaatgttcccgcaatttttgtttatggcggaacgattaaaccgggccactataaaggaaaggatctcactattgtcagcgcattcgaagccgtcggacaatatacctcccacaagatagacgcgaaagaactgctcgaagtggagcgccacgcctgtccgggagccggctcctgcggaggcatgttcactgccaatacgatgtcgtccgctttcgaagcgatgggcatgagtctcccctattcttccacgatggccgcggaggatggcgagaagctaaccagcgcggcgcgctccgcggaagtgctcgtggatgccatcaggaaacagattcgcccgcgcgacatcattacccgcaagtccattgaaaacgcgatcgcggtgatcatggccgtgggtggttccaccaatgctgttttgcacttcctcgccattgcccatgcggccgaagtgacactcaccatcgatgattttgaacgcatgcgcggcaaagtgccggtactgtgcgatctcaaaccttcgggacggtacgttgccaccgacctgcacaaggcagggggcattccccaggtcatgaaaatgctgctcgaccacggcctgttgcatggcgactgcatcaccatcagcggacagaccattgccgagatattgaaggatgtgccgtcagagcctcgcgaagatcaggatgtcattcgccagtgggacaacccgttgtacgtccagggccacctcgccatactcaagggcaatctcgccccagaagggtgcgtggcgaaaatcaccggggtgaaatccccaaaaattaccggaccggcacgcgtattcgattcggaagaagcctgcatggcagctatccttgcgcgggagatccagcccggcgacgtggtggtgatacgctatgagggacccaagggcggccccggcatgcgggaaatgctgtctcccacttccgcgcttattggcgagggactcggagattcggtgggcctgatcaccgatggacgattctccgggggcacctatggaatggtggttggacacgtggcgccggaggcgttcgtaggcgggaccattgcgctggtgcgagaaggcgattcgattaccatagacgccgagcaacggctgctgcagctcaacattcccggagatgagctggctcggcgccgggctgaatggcaaccgccccatccgcgctacacccggggagtgctcgctaaatattcgaagctcgtctcgagtgccagccgcggcgcaatcaccgactag

SEQ ID NO: 312 - protein, 557 aa, Nitrosospira multiformis
MSDNQRSRAITQGAERTPNRAMLRAVGFSDNDFDKPIVGVANGFSTITPCNKGLNELALAAEQALKQAAAMPQMFGTITVSDGISMGTEGMKYSLVSREVIADSIETAVQAESMDGVIAIGGCDKNMPGAMIAIARMNVPAIFVYGGTIKPGHYKGKDLTIVSAFEAVGQYTSHKIDAKELLEVERHACPGAGSCGGMFTANTMSSAFEAMGMSLPYSSTMAAEDGEKLTSAARSAEVLVDAIRKQIRPRDIITRKSIENAIAVIMAVGGSTNAVLHFLAIAHAAEVTLTIDDFERMRGKVPVLCDLKPSGRYVATDLHKAGGIPQVMKMLLDHGLLHGDCITISGQTIAEILKDVPSEPREDQDVIRQWDNPLYVQGHLAILKGNLAPEGCVAKITGVKSPKITGPARVFDSEEACMAAILAREIQPGDVVVIRYEGPKGGPGMREMLSPTSALIGEGLGDSVGLITDGRFSGGTYGMVVGHVAPEAFVGGTIALVREGDSITIDAEQRLLQLNIPGDELARRRAEWQPPHPRYTRGVLAKYSKLVSSASRGAITD

SEQ ID NO: 313 - DNA, 1695 bp, Chloroflexus aggregans
atgagcgataatcgccgtagtcgtatgattaccgaaggcccacagcgttcacccaatcgggcaatgctgcgcgcggtcgggtttggcgacaacgattttacgaagccgatcgtgggagtggctaacggtcacagtacgctgacaccgtgcaacgccggcttaggggcgttggcagcgcgggcggaagccgctattcgtgccgcaggaggtatgccgcagatcttcggcacgatcacggtcagcgatggtatctcgatggggactgaagggatgaagtattctttggtcagccgcgaggtgattgccgattcgattgagacggtcgtcaacgcacagcggatggacggaatccttgcggtgggtggctgcgataagaacatgcccggcgccttaattgccatggcccggctcgacattccggccatctttgtctatggtggtactatcaaacccggtcattacaaaggccgtgacttgaccatcgtcagcgtgtttgaggcagttggcgaatacagtgccggtcggatcgacgaacacgagttgctcgaaatcgagcgtcacgcatgccccggcgtcggttcgtgtggtggtatgtacactgccaatacgatgtcgtcggcaattgaagcgctgggcttgagtttacccggctcttcaaccatggctgccgaagacgaggaaaaggcgatcagcgcagctcgttccggcgaggtgttagttgaggccatccgcgccaatcgcacagcgcgccagatgttgacccgcaagtcgtttgagaatgcgattgcagtagtgatggcgttaggtggctcgaccaacgccgttttgcatctgctggcgattgcctatgctgccaacgtaccgttgaccatcgatgattttgagacgatccgccagcgggtaccggtgctctgcgatctcaagccatcgggccgctatgtggcgaccgatctccaccgtgtcggtggtgtaccgcaggtgatgaagatgttgttgaatgccggcttactccacggtgattgtatgacgattaccggacagacaatcgctgaggtgctggccgatgtacccgacgagccgccggccgatcaagatgtcatccgcccctttcataaacccctctatccgcaaggacatttggccatcctccgtggtaatctggccgaagaaggctgcgttgcgaagattaccggtattaagcagcgctcgattaccggaccggcccgtgttttcgatgccgaagaggaatgtctcgaagcgattttgagtggcaagattaagccgggcgatgtcgtggtgatccggtacgaagggccgaagggtggtcccggtatgcgtgaaatgctcgctccgacatcggcgattatcggtgccggtttgggcgatagcgttggcctgattaccgacggacgcttctctggtggtacgtatggcttggtggtcggtcatgttgcccctgaagcggcggttggtggcaccattgccctggtcgaagagggtgatagtatcacgattgacgccgatgcccgtctcttgcagctcaatgtctcggacgaagagttggcacgacgccgtgctgcgtggcaaccccgtccgccacgctatacccgtggtgtattggcgaagtatgccaggctggtgtcgtcggctagccttggtgcagtgaccgaccgcttcgatggcgagtcggcgtaa

SEQ ID NO: 314 - protein, 564 aa, Chloroflexus aggregans
MSDNRRSRMITEGPQRSPNRAMLRAVGFGDNDFTKPIVGVANGHSTLTPCNAGLGALAARAEAAIRAAGGMPQIFGTITVSDGISMGTEGMKYSLVSREVIADSIETVVNAQRMDGILAVGGCDKNMPGALIAMARLDIPAIFVYGGTIKPGHYKGRDLTIVSVFEAVGEYSAGRIDEHELLEIERHACPGVGSCGGMYTANTMSSAIEALGLSLPGSSTMAAEDEEKAISAARSGEVLVEAIRANRTARQMLTRKSFENAIAVVMALGGSTNAVLHLLAIAYAANVPLTIDDFETIRQRVPVLCDLKPSGRYVATDLHRVGGVPQVMKMLLNAGLLHGDCMTITGQTIAEVLADVPDEPPADQDVIRPFHKPLYPQGHLAILRGNLAEEGCVAKITGIKQRSITGPARVFDAEEECLEAILSGKIKPGDVVVIRYEGPKGGPGMREMLAPTSAIIGAGLGDSVGLITDGRFSGGTYGLVVGHVAPEAAVGGTIALVEEGDSITIDADARLLQLNVSDEELARRRAAWQPRPPRYTRGVLAKYARLVSSASLGAVTDRFDGESA

SEQ ID NO: 315 - DNA, 1674 bp, Leptospirillum sp.
atgaaaaagccatttcgaagccggaccatcacccagggagtggaaagatctcccaacagggccatgctccgggccgtcgggttccaggatggggattttgaaaaaccgattatcggagtggcgaatggctacagcaccattacaccctgcaacatgggcctgaacagtctggctcttcgtgccgaggacgccattcgccagagaggagccatgccccagatgttcggaaccatcacggtttcggacggaatatcgatgggaacggaaggaatgaagttttccctggtgtcccgggaagtcatcgccgactccatcgaaacggcggtcagcgcccaaagcatggacggcgtgatcgccatcggggggtgcgacaagaacatgccgggagccctgatcgccatggggcgcatgaacatcccctccatttttgtttatggaggaaccatcaagcccggccactgggaaggtcaggacctgacggtcgtgagctcgttcgaagcggtcggggcctactcggcaggcaagatggacgaggcaaccctgaccgaaatcgagcgtcatgcctgtccgggagccggatcctgtggcggcatgttcactgccaataccatgtcgtcggcgatcgaagccatggggatgagtttgccctattcctccaccatggcagcggaagaccttgaaaaagccgaaagcgcagccgaatccgcaagagttcttgtccaggcggttctgaacgacctgcgtcctcgacagatcctgaccagaaaggcctttgaaaacgccattgcagtcctgatggccgttggaggctcgacgaacgcggttcttcacctcctcgcgatcgcccgctccgtcgacgtccccctttccatagacgactttgaacacattcgacgaaaggtccctgtcctttgcaacctcaagccctccggggcctatgtcgccacacagcttcacgctgtcgggggcattcccctcgtcatgcgcatgctgctggacaacggactccttcatggcgacgcgctgaccattacagggaagacgatttccgagacgctccgggacgttccttcccgtcccccggccggacaggatgtcgtgctcccctttgacaaacccgtttaccgggagggccaccttgcgatcctgaagggaaatctcgccccggaaggatcggtcgcaaagatctcgggcatcaaacaccgttccattaccggcccggcccgggtcttcgactccgaagaacgctgcatggcagccatcctggcccgggaaattcgtcccggagacatcgtcgtgatccggtacgaaggccccaaaggcggtcccggaatgcgggaaatgctggccccgacctccgccctgatcggagaaggtctcggggactcggtcggcctgattacagatggacgtttttccgggggcacatacggcatggtggtgggtcacgtctcgccggaagcggctgtgggcgggccgatcggactggtgcaggaaggagacctcattacgatcgacgccgaccggaatctgatcgaggtcaaggtttcaccggacgaaatgacaagaagaaaatctctgtggaaggaaccccctctccgatacacaaaaggaatcatggccaaataccgtcttctcgtcaaaagtgccagcgaaggcgccgtgacagactga

SEQ ID NO: 316 - protein, 557 aa, Leptospirillum sp.
MKKPFRSRTITQGVERSPNRAMLRAVGFQDGDFEKPIIGVANGYSTITPCNMGLNSLALRAEDAIRQRGAMPQMFGTITVSDGISMGTEGMKFSLVSREVIADSIETAVSAQSMDGVIAIGGCDKNMPGALIAMGRMNIPSIFVYGGTIKPGHWEGQDLTVVSSFEAVGAYSAGKMDEATLTEIERHACPGAGSCGGMFTANTMSSAIEAMGMSLPYSSTMAAEDLEKAESAAESARVLVQAVLNDLRPRQILTRKAFENAIAVLMAVGGSTNAVLHLLAIARSVDVPLSIDDFEHIRRKVPVLCNLKPSGAYVATQLHAVGGIPLVMRMLLDNGLLHGDALTITGKTISETLRDVPSRPPAGQDVVLPFDKPVYREGHLAILKGNLAPEGSVAKISGIKHRSITGPARVFDSEERCMAAILAREIRPGDIVVIRYEGPKGGPGMREMLAPTSALIGEGLGDSVGLITDGRFSGGTYGMVVGHVSPEAAVGGPIGLVQEGDLITIDADRNLIEVKVSPDEMTRRKSLWKEPPLRYTKGIMAKYRLLVKSASEGAVTD

SEQ ID NO: 317 - DNA, 1677 bp, Leptospirillum sp.
atgaaagacaaccggagaagtcgtgtcacgaccgaaggcgtggagcgctctcccaaccgggccctgcttcgggccacggggttccgggacgacgattttggcaagccgattgtcggggtggcgaacgcccacagttccatcaccccctgcaatatggggatcgggaaactcgcttcgcgggcggaagaagctctccgcaaggccggctccatgccccagaccttcgggaccatcacggtgtcggacggaatctcgatgggcaccgaaggcatgaaatattccctcgtctcgagggaagtgattgccgattcgatcgaaacggtcgtgaacgcgcagagcatggacggccttctggcgttcgggggatgcgacaaaaacatgccgggggcactgatcgcgatgggccgtctcgacattccctccgtcttcgtctacggagggacgattcgtccgggacaccacaacggacaggacctgaccgtcgtcagcgccttcgaggccgtcggggaatatctcgcgaaccggatcgaccgggaagaacttctggcaatcgaacgccacgcctgtcccggagccggatcctgcggcgggatgtttaccgccaacaccatggcagccctgatcgaaaccatgggcatgagcctcccctattcctccacgatggccgccgaagacgcggaaaaatcggaaaacgcggaagagtccgcgaagatcctggtcaacgccatccggaaccagatccgtccccgccagattctgacgcggcatgccttcgaaaatgcgatcgcggtcacgatggccatcggagggacgaccaacgccgttctgcatctccttgccatcgcccgggcggtcgaggttccgctttcgatcgacgacttcgccgcaatccgggaacgggtccctgttctgtgcgatctcaagccatgggggcggtatgtggcaaccgaccttcaccgggcgggagggattccccaggtcatgaaaatcctgttgtcgaacggactgttgcatggggaagccctttccgtcaccggccggaccatcgcggaactgctggaaaacatcccggaagaccccccgaaagaagatcaggatgtgattcgtccgtttcgcgcgccggtcctcgaacgggggcatatcgccatcctccggggaaacctcgcccccgacggatcggtggccaaagtgacggcctcccgtcctgtggcattcacgggaccggcccgtgtcttcgattcggaagaagacggcatgaaggccattctggcaagagagatccgtccgggagatgtcgtagtcatccgttacgagggtcccgtgggaggaccgggcatgcgggaaatgctcgcaccgaccgccgcccttgtcggggaaggcctgggggagagcgtggcgctggtcacggatggacggttctccggaggaacccgggggatggtcgtgggtcatgttgcacccgaagcggccgtgggaggaccgatcgccctggttgccgacggcgatccggtcacggtcgaccccggacggagctgtctccggctcgatgtgccggaggaggaatttctccgccggcaggccgcatggcgtccccgtccgccccgcaccctccggggggttctggcgaagtacgcccggcaggtctcttcggccagcgaaggcgccgtcaccgactga

SEQ ID NO: 318 - protein, 558 aa, Leptospirillum sp.
MKDNRRSRVTTEGVERSPNRALLRATGFRDDDFGKPIVGVANAHSSITPCNMGIGKLASRAEEALRKAGSMPQTFGTITVSDGISMGTEGMKYSLVSREVIADSIETVVNAQSMDGLLAFGGCDKNMPGALIAMGRLDIPSVFVYGGTIRPGHHNGQDLTVVSAFEAVGEYLANRIDREELLAIERHACPGAGSCGGMFTANTMAALIETMGMSLPYSSTMAAEDAEKSENAEESAKILVNAIRNQIRPRQILTRHAFENAIAVTMAIGGTTNAVLHLLAIARAVEVPLSIDDFAAIRERVPVLCDLKPWGRYVATDLHRAGGIPQVMKILLSNGLLHGEALSVTGRTIAELLENIPEDPPKEDQDVIRPFRAPVLERGHIAILRGNLAPDGSVAKVTASRPVAFTGPARVFDSEEDGMKAILAREIRPGDVVVIRYEGPVGGPGMREMLAPTAALVGEGLGESVALVTDGRFSGGTRGMVVGHVAPEAAVGGPIALVADGDPVTVDPGRSCLRLDVPEEEFLRRQAAWRPRPPRTLRGVLAKYARQVSSASEGAVTD

SEQ ID NO: 319 - DNA, 1698 bp, Halorhodospira halophila
atggcggataaccgtcgcagccgagtgatcacccagggcgtggcccgaacccccaaccgcgcgatgctgcgcgccgtcggtttccgggatgaggatttcgagaagccgatcatcggggtcggcaacgcgcacagtacgatcaccccctgcaacgtcgggatcggcgccatggcgcggcgcgccgaggaggcgctgcgcgaggtgggggcgatgccgatgaagttcggcaccatcaccgtctccgacgggatcaccatgggcaccgagggcatgaagtactccctggtctcccgcgaggtgatcgccgattcgatcgagacggtgggcggtggccagcggatggacggcatgctcgccactggtggctgcgacaagaacatgcccggggcgatgatggccctggcccgtctggatatcccgggtatcttcgtctatggcggcaccatcaagccgggtcattacaagggcgaggatctcaccgtggtcagcgccttcgaggcggtggggcagtacaacgccggcaacctctccgaggccgatctcaagggggtcgaggagaacgcctgccccggggcgggcgcctgtggcggcatgttcacggccaacaccatgtccagcgccttcgaggccatgggcatgagcctgatgggctcgtccaccgtctctgccgaggacgacgaggcccgggatgtggccgccgaggcgtcccgggtcctgatggacgctgtccatcacgaccggcgcccgtcctcgatcctcacccgcgaggccttcgagaacgcctttgcggtggtgatggccctgggcggctccactaacgccgtgctccacctgctggccatcgccaataccgccgaggtgccgttcgacctcgacgacgtcgagcgcatccgccgcaaggtgccggtactctgcgacctcaagccgtcgggccggttcgtgaccagtcagttccacgaggtcggcggcacgccgcaggtgatgcgcatcctcctggagcaggggctgttgcacggccactgccagaccatcaccgggcagaccatcgaggccctcatcggccacctgccgccggagccgccggcggatcaggagatcatcatgcccttcgatcggccgctctatcccgagggtcacctggcaatcctgcggggcaacctggctgaagagggtgccgtggccaaggtcagtggcatccaacagcgccgtatcagcggaccggcccgcgtgttcgattccgaggaggagtgcctggaggccatcctggccgacggggtgcaggccggtgacgtggtgatcgtccgctacgaggggcccaagggagggcccggcatgcgcgagatgctggcgcccacctcggcgatcatcggcaaggggctcggcgatgcggtggggctgatcactgacggccgtttctccggcgggacctacgggatggtggtcgggcacgtggcgcctgaggcctacgacggcgggaccatcgcgctgattgccgagggcgatacggtgaccatcgacgccgaccagaacctgcttcaggtggaggtggatgacgcggagctcgagcgtcgccgcagccagtggcaggtgccccggcctcgctaccgtcgcggggtgttgggcaagtatgcgcgcctggcggcctcggccagtcgcggtgcagtgaccgacgccgacctcttccccgagcaggagtag

SEQ ID NO: 320 - protein, 565 aa, Halorhodospira halophila
MADNRRSRVITQGVARTPNRAMLRAVGFRDEDFEKPIIGVGNAHSTITPCNVGIGAMARRAEEALREVGAMPMKFGTITVSDGITMGTEGMKYSLVSREVIADSIETVGGGQRMDGMLATGGCDKNMPGAMMALARLDIPGIFVYGGTIKPGHYKGEDLTVVSAFEAVGQYNAGNLSEADLKGVEENACPGAGACGGMFTANTMSSAFEAMGMSLMGSSTVSAEDDEARDVAAEASRVLMDAVHHDRRPSSILTREAFENAFAVVMALGGSTNAVLHLLAIANTAEVPFDLDDVERIRRKVPVLCDLKPSGRFVTSQFHEVGGTPQVMRILLEQGLLHGHCQTITGQTIEALIGHLPPEPPADQEIIMPFDRPLYPEGHLAILRGNLAEEGAVAKVSGIQQRRISGPARVFDSEEECLEAILADGVQAGDVVIVRYEGPKGGPGMREMLAPTSAIIGKGLGDAVGLITDGRFSGGTYGMVVGHVAPEAYDGGTIALIAEGDTVTIDADQNLLQVEVDDAELERRRSQWQVPRPRYRRGVLGKYARLAASASRGAVTDADLFPEQE

SEQ ID NO: 321 - DNA, 1689 bp, Nitrococcus mobilis
atggccgataatcgccgcagccgcgtgatcacctacggtgtggcccgtacgcctaatcgggccatgctgcgcgctgtcggttttaccgacactgatttcgataaaccgatcgttggagtgggcaatgcccacagcaccatcacaccctgtaatgtgggcatcggtgcattagcggctcaggccgaacaggcgctgcgtgaagccggtgccatgccggtcagctttggcaccatcactatttctgatggtatatccatgggcacggaggggatgaagtactcgctggtctcgcgcgaggtcatagccgatgccatcgaaacggtaggcaacggccagtgcctggatggcatgctcgccaccggtggttgcgacaagaacatgccgggcgccatgattgccatagcacgcatgaatattccggcgatcttcgtttatggcggcaccatcaagccgggtcgctataagggtcaggatctgaccatcgtcagcgctttcgaggcggttggacagtatgccgccggcaaactctcagtcgaggatttgcagggcgtggaacgcaacgcttgccccggtgccggtgcctgcggcgggatgtacacggctaataccatgtccagcgccttcgaggccttgggtatgagcctgatgggctcctccaccctgtgcgcggaggatccggagaaagtgcagagtgcgcggcgctcggctcaagtcctggtagacgccatccaggaacagcgtttaccgcgtgccataatgacccgccaggcgttcgaaaacgcctttgcggtggtcatggcgctcggcggatcgaccaatgccgtgctgcatttgttggcgatcgccaacgctgcggaggtcgattttagcattgacgatgtcgaaaccatccgccgccaggtgcccgtgctctgcgagctcaagccctccgggcgcttcgtaaccagccagtttcatgaggtcggcggtactccgcaggtcatgaagatccttttggcccacggcttattgcacggcgcttgccttactgtttccgggcattctattgctgaattgttggccgacataccggccgagccgccgagcgaccaggatatcattcggcctttcaagcagccgctgtacccgcagggacatctcgccatcctgcgcggcaatctggcggaggagggtgccgtcgccaaggtcaccggcatcaaacagcgccggatcacaggtccggcacgggttttcgactccgaagagggtgccctggaggcgattctggcggatcaaatcgtggcgggtgacatcgtcgtgattcgttatgagggcccgaagggtgggccgggcatgcgcgagatgctggcgccgacctcggcgatcatcggtaaaggtttgggtgatgcggtaggtcttattaccgacgggcgcttctccggtggtacctatgggatggtggtcggtcatgttgcaccagaggcggcagtcggcggtacgattgccttggtgcgggagggtgatgaaatcacgatcgatgccgatcgcaatctgctgatgctccatgtcgccgacacggaaattgtccagcgccgagccgcctggcagccgccacggcctatttatcgtcgcggtgtgctcgcgaagtacgccaagttggtctcctcggcgagcattggagcggttacggacaaagatctattcgactga

SEQ ID NO: 322 - protein, 562 aa, Nitrococcus mobilis
MADNRRSRVITYGVARTPNRAMLRAVGFTDTDFDKPIVGVGNAHSTITPCNVGIGALAAQAEQALREAGAMPVSFGTITISDGISMGTEGMKYSLVSREVIADAIETVGNGQCLDGMLATGGCDKNMPGAMIAIARMNIPAIFVYGGTIKPGRYKGQDLTIVSAFEAVGQYAAGKLSVEDLQGVERNACPGAGACGGMYTANTMSSAFEALGMSLMGSSTLCAEDPEKVQSARRSAQVLVDAIQEQRLPRAIMTRQAFENAFAVVMALGGSTNAVLHLLAIANAAEVDFSIDDVETIRRQVPVLCELKPSGRFVTSQFHEVGGTPQVMKILLAHGLLHGACLTVSGHSIAELLADIPAEPPSDQDIIRPFKQPLYPQGHLAILRGNLAEEGAVAKVTGIKQRRITGPARVFDSEEGALEAILADQIVAGDIVVIRYEGPKGGPGMREMLAPTSAIIGKGLGDAVGLITDGRFSGGTYGMVVGHVAPEAAVGGTIALVREGDEITIDADRNLLMLHVADTEIVQRRAAWQPPRPIYRRGVLAKYAKLVSSASIGAVTDKDLFD

SEQ ID NO: 323 - DNA, 1692 bp, Alkalilimnicola ehrlichei
atgagtgagaaccgccgcagtcgggtcgtgaccgcaggcctgcgccgcacccccaaccgggccatgctgcgcgccaccggcttccgggacgaggacttcgacaagcccatcatcggcgtcgccaacgcccacagcaccatcaccccctgcaacatgcatatcgccgcgctcacccggcgggcggtggaggcgttgcaggcggccggtgccatggcaccggaatttggcgtgcccaccgtctcggacggcatcgccatgggcacgccggggatgcgctactcgctggtctcgcgcgaggtgatcgccgacgccatcgagacggtgtgcgagggccagagcctggacggcgtgctggccaccggcggctgcgacaagaacatgcccggggctatgatcgccatcgcgcgcatgaacataccggccctgtttgtctacggcggcaccatccgccccggctactacaagggcgagcggctggacatcgtctcggcgttcgaggcggtgggccaggcctccgcgggcaggatgagtgacgaggacctgcttggggtggagcgcaacgcctgccccggcgccggctcctgtggcgggatgtacaccgccaacaccatgtccagcgccttcgaggccatgggcatgagcctgcccgccagctccaccgtggccgccgaggcggaggagaagggcgacgacgtggcggccgccgcgcgggtgctgatggaggcggtgcgggcggatcgcaagccccgcgacatcctcacccgcgaggccttcgagaacggcttcgccctggtgatggccgtgggcgggtccaccaacgcggtgctgcacttgctggccatcgccgatgcggccgatgtgccgttgtcgctggacgacgtggagcgtatccggcagcaggtgcccgtgctctgcgatctgcggccctcgggccgctacgtgaccactgaatttcacgaggtgggcggcacgccgcaagtgctgcgcctgctgctggacgcgggcctgctccacggcgactgcctcactattaccgggcagacgcttgccgagaccctggccgacgtgcccccgacccccgcgaaggatcaggacatcatccggaccctggacaaccccctctacccggtgggccatctggccatcctgcgtggaaacctggcagaggagggggccgtggccaaggtgtccggccttaagcagcgccgcatcgtcggaccggcgcgggtattcgagggtgaggaggactgcctggaggcgatcctggccggccagattaagcccggcgacgtggtggtcatccgccacgaggggccgaagggcgggcccggcatgcgcgagatgctctcgcccaccgcggcgttgatgggggccgggctgggggagagcgtcggcctgatcaccgatgggcgcttctccggtggcacccgggggctggtggtgggccacgtggcgccggaggccgcagcgggtggcaccatcgccctggtccgggaaggcgacaccgtcaccatcgatgcggacgccaaccggctcaccctggaggtggacgaggcggagctcgcccgccggcgtgcggcctggcagccgccggaaccgagagcgacccggggcgtattgggcaagtacgcgcagatggtcggctcggcggcgcagggtgcggtcaccgatcgctggagcggcggcgcgtga

SEQ ID NO: 324 - protein, 563 aa, Alkalilimnicola ehrlichei
MSENRRSRVVTAGLRRTPNRAMLRATGFRDEDFDKPIIGVANAHSTITPCNMHIAALTRRAVEALQAAGAMAPEFGVPTVSDGIAMGTPGMRYSLVSREVIADAIETVCEGQSLDGVLATGGCDKNMPGAMIAIARMNIPALFVYGGTIRPGYYKGERLDIVSAFEAVGQASAGRMSDEDLLGVERNACPGAGSCGGMYTANTMSSAFEAMGMSLPASSTVAAEAEEKGDDVAAAARVLMEAVRADRKPRDILTREAFENGFALVMAVGGSTNAVLHLLAIADAADVPLSLDDVERIRQQVPVLCDLRPSGRYVTTEFHEVGGTPQVLRLLLDAGLLHGDCLTITGQTLAETLADVPPTPAKDQDIIRTLDNPLYPVGHLAILRGNLAEEGAVAKVSGLKQRRIVGPARVFEGEEDCLEAILAGQIKPGDVVVIRHEGPKGGPGMREMLSPTAALMGAGLGESVGLITDGRFSGGTRGLVVGHVAPEAAAGGTIALVREGDTVTIDADANRLTLEVDEAELARRRAAWQPPEPRATRGVLGKYAQMVGSAAQGAVTDRWSGGA

SEQ ID NO: 325 - DNA, 1695 bp, Deinococcus geothermalis
atgacggacacccgcaccaagcgcagaatgaactggaacagtcaccacatcacgcagggtgacgagcgggcgcccaaccgcgcgatgctgcgggcggtgggcttcgaagacggcgacttcgacaaggcgatcatcggggtggcgcacgcccagagcaacatcacgccctgtaacaacgggctgggcgaactcgccgaccacatcaccggtgcgcttcgcgagggcggagcgatgccgcaggtgtacggcaccatcacggtgtctgacggcatcagcatgggcaccgagggcatgaagtgctctcttgtcagccgggaagtgatcgcagactccatcgaaaccgtctcgcgtgggcaatcgcacgacggcctgattgtggtgggcggctgcgacaagaatatgcccggcgcaatgatcggcatcgcccggttgaatattcccgcgatcttcgtgtacggcgggaccatcaaaccggggcactatcagggcaaagacctcaccatcgtttcggtcttcgaggcggtgggggcctacggcgcgggcaagatgagccgcgaggacttcgagcagatcgagaaacgcgcctgtcccggcaacggttcctgtggcggcatgtacaccgccaacaccatgagcagtgccttcgaggcgatgggcatgagcctgccctattcgtccaccatgagtgccgtggacgccgaaaaggccgtttcggctgcggacagcgcccgcgccctgatccggttgatcgagcaggacatccgcccgctggacatcctgacgaaaaaagcctttgagaacgccatcacggtggtcatggcggtgggcggctcgaccaacgccgtgctgcacctgatggcgattgcccacgcctgcggtgttgacctcacgctggaagacttcgagcgcattcgcgagcgcacgccggtcttctgtgaccttaagcccagtggaaagtacgtcgccacggatctgcacgaggtcggcggcattccgcgcgtgatgaagatgctgctcaaagcgggcttgctgcacggcgactgcctgacagtgaccggacagacggtggccgagaacctggcggacgtgcccgaccagcccgaccccggccaggacgtcattctgcccttcgatcagccgctctactcgcaggggcacctcgccatcttgcggggcaacctggccccggaaggcagtgtcgccaagatcagcggcctgcggcagatcaagatcaccggtcccgcccgcgtctttgattcggaagaagagtgcatggcggcgatcatgggcgatcagatcaaggccggtgacgtgatcgtgattcgctacgaaggccctaagggcggccccggcatgcgcgagatgctctcgcccaccagcgcgatcatcggcaaaggcctgggcgacagcgtggggctgatcacagacggacgcttcagcggcggcacctacggcctggtggttggccacgtcgcgcccgaagcctatgtaggcggccccatcgcgctggtgcaggaaggcgacatcatcgagctgaacgccgaaacctgcgagctgacgctgcatgtggacgacgcagaactggagcgccgccgcgccgcgtgggtggccccggaaccgcgctaccggcggggcgtcctggcaaagtacgcgcgactagtaggcagtgcggcgcggggagcggtgaccgattag

SEQ ID NO: 326 - protein, 564 aa, Deinococcus geothermalis
MTDTRTKRRMNWNSHHITQGDERAPNRAMLRAVGFEDGDFDKAIIGVAHAQSNITPCNNGLGELADHITGALREGGAMPQVYGTITVSDGISMGTEGMKCSLVSREVIADSIETVSRGQSHDGLIVVGGCDKNMPGAMIGIARLNIPAIFVYGGTIKPGHYQGKDLTIVSVFEAVGAYGAGKMSREDFEQIEKRACPGNGSCGGMYTANTMSSAFEAMGMSLPYSSTMSAVDAEKAVSAADSARALIRLIEQDIRPLDILTKKAFENAITVVMAVGGSTNAVLHLMAIAHACGVDLTLEDFERIRERTPVFCDLKPSGKYVATDLHEVGGIPRVMKMLLKAGLLHGDCLTVTGQTVAENLADVPDQPDPGQDVILPFDQPLYSQGHLAILRGNLAPEGSVAKISGLRQIKITGPARVFDSEEECMAAIMGDQIKAGDVIVIRYEGPKGGPGMREMLSPTSAIIGKGLGDSVGLITDGRFSGGTYGLVVGHVAPEAYVGGPIALVQEGDIIELNAETCELTLHVDDAELERRRAAWVAPEPRYRRGVLAKYARLVGSAARGAVTD

SEQ ID NO: 327 - DNA, 1695 bp, Polynucleobacter sp.
atgaaacgcctcaatgaacgctctcgcatggttaccgagggggtcgctcgcgcacccaatcgttcgatgtactacgcgatgggttacgaagaaaaggatttcgtaaaaccaatggttggcgttgcaaacggccactccactattaccccttgcaatagtggcttacaaaaattagctgatgccgcagttgaagctctagaagcagctggcgcaaaagcacaagtatttggtacgccaaccgtttctgatggtattggtatgggtactgagggtatgaagtattccctcgtctcacgagaagtgattgctgacagtattgaagtttgtgtaaacggtctttggcaagatggcgtagtagtcattggtggctgcgataaaaatatgcctggtggcatgatggctttagctcgcacgaatgtacctggcatctatgtatatggtggcacgattaagccaggccactttaaaggcaaggaattgaatattgtttctgcatttgaagcagttggtgaatttacctccggtcgattgagtgaagaagatttaaaaggtgttgagcaacacgcctgcccaggtagcggctcttgcggtggaatgtacacggccaataccatgagctcttcatttgaggctttgggtatgagcttgccctactcttctacgatggcaaacgttgacgctgaaaaagtagcgagcgctgccgaatcagcgcgcgtcctcgttgaagccgttaaaaacaacctgcgcccacgcgacatcattaccaagaaatccgttgagaatgcggttagcgtcatcatggcagttggcggttcaaccaatgcagtgttgcatttcttggcgattactagtgccgctgaaattgattggacaattgatgactttgaacggattcgtaagcaagtcccagtcatcgttgatatgaaaccctctggcacttatttagcaactgacttacaccaagctggcggtattccacaagtcatgaagattttgcttgacggtggcctgcttcatggcgattgcatcaccattaccggaaaaactattgctgaagtattaaaagatgttccatcagtgccgcgcgctgatcaaaaagtcattcgcacgctagacaacccactctacaagcaaggtcacttagcgattctgaagggcaatatttctccagaagggtgcgttgccaaaattactggcctcaagaatccatcgattactggcccagctcgagtctttgattctgaagatgatgcgatggctgccatcatggctcagaagatcaaagatggcgacatcgtggtgattcgttacgaaggccctaaaggcggtcctggtatgcgtgaaatgcttgcccctacctctgccctagttggtcaaggtttaggcgagtcagttggcctcatcaccgatggtcgcttctctggtggtacttggggcatggtagttggtcacgttgctcctgaggcctttgtagggggcacaattgccctcatcaacgaaggtgactcagtcacgatagatgctcaccaacttcttattcagctcaacgtcagcgaagaagaaattgctaagcgacgcgcagcttggaaacaacctaagccacgctatacccgcggcttacttgcgaagtatgcaagccttgctagtagtgcgagcaaaggtgctgtaaccgatttgaatttagatttgacctaa

SEQ ID NO: 328 - protein, 564 aa, Polynucleobacter sp.
MKRLNERSRMVTEGVARAPNRSMYYAMGYEEKDFVKPMVGVANGHSTITPCNSGLQKLADAAVEALEAAGAKAQVFGTPTVSDGIGMGTEGMKYSLVSREVIADSIEVCVNGLWQDGVVVIGGCDKNMPGGMMALARTNVPGIYVYGGTIKPGHFKGKELNIVSAFEAVGEFTSGRLSEEDLKGVEQHACPGSGSCGGMYTANTMSSSFEALGMSLPYSSTMANVDAEKVASAAESARVLVEAVKNNLRPRDIITKKSVENAVSVIMAVGGSTNAVLHFLAITSAAEIDWTIDDFERIRKQVPVIVDMKPSGTYLATDLHQAGGIPQVMKILLDGGLLHGDCITITGKTIAEVLKDVPSVPRADQKVIRTLDNPLYKQGHLAILKGNISPEGCVAKITGLKNPSITGPARVFDSEDDAMAAIMAQKIKDGDIVVIRYEGPKGGPGMREMLAPTSALVGQGLGESVGLITDGRFSGGTWGMVVGHVAPEAFVGGTIALINEGDSVTIDAHQLLIQLNVSEEEIAKRRAAWKQPKPRYTRGLLAKYASLASSASKGAVTDLNLDLT

SEQ ID NO: 329 - DNA, 1692 bp, Polynucleobacter necessarius
atgaaacgcctaaatgaacgctcgcgcatggtcacagaaggggtcgcacgcgcacctaatcgttcgatgtattacgcaataggttacgaagaaaaggatttcgtaaagccaatggttggcgttgcgaatggtcactccactatcaccccttgtaatagtggtttacaaaaattagccgatgctgcagtttctgcgcttgaaggtgctggtgcaaaagcacaaatgtttggcaccccaaccgtttccgatggcataggcatgggcacagaaggcatgaagtattcactcgtgtcacgcgaagtgattgctgacagtattgaaacttgtgtaaatggactgtggcaagacggtgtagttgtgattggcggctgcgataaaaatatgccaggcggcatgatggctttagctcgcaccaatgtgcccggcatctatgtatatggcggcacaattaagccaggccactacaaaggtaaagaccttaatatcgtttcagcgtttgaagcagttggtgaatttacctccggcagactcagcgaagaggatttaaaaggtgtagaacaacatgcctgtccgggtagcggctcctgcggtggtatgtataccgccaacacaatgagctcggcctttgaggccttaggcatgagcctcccctactcctcaacgatggcaaacgaagatgcagaaaaagtagcaagcacacatgattctgctgtcgtattggttgaagcgatcaaaaagaacttgcgtccacgcgacatcattaccaagaaatcgattgagaacgctgttagcgtaatcatggctgttggtggatctacaaatgcggtgctgcatttcttggcgattactagcgccgctgaaatcgattggaccattgatgattttgaacgcattcgtaagcgcgttcctgtaatcgtggatatgaaaccatcgggcacctaccttgctaccgatttgcatcaagctggcggcattcctcaagtgatgaagattttgctcgacgacggattgctccacggcgattgcatgactatcactggcaaaacagttgcggaagtgttgaaagatgttccatccgtaccgcgcgccgatcagaaagtgatccgtaccttagataatcctttgtataaacaaggtcacttggcaatcttgaaaggcaatatctcaccagagggttgtgtgaccaagataaccggcctcaaaaatccatcgatcaccggcccagcacgcgtctttgattctgaagatgatgctatggcagccatcatggcacagaagattaaagatggtgacatcgtggtcattcgctatgaaggccctaaaggcggccctggtatgcgcgaaatgcttgcccccacctctgccctagttggtcaaggtttaggcgaatctgtggggcttattaccgatggccgcttctctggtggcacttggggcatggtcgttggccacgtggcaccggaagcttatgtcggtggaaccatcgccctcattcatgagggtgactctgtcacgatcgatgcgcataagctactcattcagctgaatgtagatgatgcagagatcgctaaacgtcgcgcagcctggaagcaacccaagccacgctacacccgcggcttgcttgcaaagtatgccaaacttgctagcaccgcaagcaaaggggcggtgaccgacttaaatttgaatgattag

SEQ ID NO: 330 - protein, 563 aa, Polynucleobacter necessarius
MKRLNERSRMVTEGVARAPNRSMYYAIGYEEKDFVKPMVGVANGHSTITPCNSGLQKLADAAVSALEGAGAKAQMFGTPTVSDGIGMGTEGMKYSLVSREVIADSIETCVNGLWQDGVVVIGGCDKNMPGGMMALARTNVPGIYVYGGTIKPGHYKGKDLNIVSAFEAVGEFTSGRLSEEDLKGVEQHACPGSGSCGGMYTANTMSSAFEALGMSLPYSSTMANEDAEKVASTHDSAVVLVEAIKKNLRPRDIITKKSIENAVSVIMAVGGSTNAVLHFLAITSAAEIDWTIDDFERIRKRVPVIVDMKPSGTYLATDLHQAGGIPQVMKILLDDGLLHGDCMTITGKTVAEVLKDVPSVPRADQKVIRTLDNPLYKQGHLAILKGNISPEGCVTKITGLKNPSITGPARVFDSEDDAMAAIMAQKIKDGDIVVIRYEGPKGGPGMREMLAPTSALVGQGLGESVGLITDGRFSGGTWGMVVGHVAPEAYVGGTIALIHEGDSVTIDAHKLLIQLNVDDAEIAKRRAAWKQPKPRYTRGLLAKYAKLASTASKGAVTDLNLND

SEQ ID NO: 331 - DNA, 1704 bp, Azoarcus sp.
atgtccgaccctacccgtccagcccggatcgatgaacgttcccgcaacgtgaccgaaggcgtgatgcgggcgcccaatcgatcgatgtactacgcgatgggctatcgggaaactgatttcggcaagccgatggttggcgtggcgagcgcacattcgacgatcacgccctgcaacagcgggctgcaaccgctggccgataccgtggccgcggccttgaaggaggccggggccaatccgcaactgttcggtactcccaccgtgtccgacggcatcggcatgggcaccgagggcatgaagtattcgctggtatcgcgggaagtgatcgccgacagcatcgagacctgcgtcaatgggctgtggcaggacggggtcgtcgtgatcggcggatgcgacaagaacatgcccggcggcatgatggcgcttgtccgcaccaacgtgcctggaatctatgtctatggcggcacgatcaaaccggggcattacaagggcagggatctgaacatcgtctcggttttcgaggcggtgggggaattcatcgcggggcagctcgacccggtcgatttcaaggaaatcgaaaagcgcgcctgccccggcagcggctcgtgcggcgggatgtacacggcaaacacgatgagcgccgcgttcgaggcgctcggcatgagcctgccatattcttcgacgatggccaacgaggacgctgagaagctcgcgagcgccgcggagtccgcccgggtgctggtggaggcgatcaaacgcggccttcgcccgcgcgacatcgtcacccgggaggcgatcgagaacgctgtcagcgtgatcatggcgacgggaggctcgaccaacgcggtgctgcactttctggcgattgcccacgcggccgaagtgccgtggacaatcgacgacttcgagcgcattcggcgtcgcgtgccggtcatcgtcgacatgaagccgtccgggcgctacctcgcgaccgatctccatcaggcaggcggcatcccgcaggtgatgaagctgctgctcgacgccgggctgctgcatggcgcgtgcgtcacgatcaccgggcagacgatcgcggaggtcctggagaacgtgccggcggcaccgcgtgccgatcagggcgtcatccggacgctgtccgatccgctgtacgcggagggccatctggcgatcctcaggggcaacctctcgccggaaggctgcgtggcgaagatttcgggcctgaagaatcccgccatcaccggcccggcgcgcgtcttcgactccgaggacgacgcgatggcggcgatcatggcgcgccggatcgtggagggtgacgtcgtggtaatccgctacgagggacccaagggcggccccggcatgcgcgagatgctcgccccgacgtcggcgctcgtcgggcaggggctgggagagtcggtcgggctgatcactgacggccgcttctcgggaggcacctggggcatggtcgtcggccacgtttcccccgaagcgttcgtcggtggcccgattgcgctggttcgcgaaggggactcggtcacgatcgacgcgcaccggcagctcgtccagctgaatgtcggtgatgaagagctcgcgcgccgagccgccgactggacgccgccgtccccgcgctacacccgcggcgtgctggcgaagtttgcgaagttcgccagttccgcgagcaagggcgcggttaccgatctggacttgtag

SEQ ID NO: 332 - protein, 567 aa, Azoarcus sp.
MSDPTRPARIDERSRNVTEGVMRAPNRSMYYAMGYRETDFGKPMVGVASAHSTITPCNSGLQPLADTVAAALKEAGANPQLFGTPTVSDGIGMGTEGMKYSLVSREVIADSIETCVNGLWQDGVVVIGGCDKNMPGGMMALVRTNVPGIYVYGGTIKPGHYKGRDLNIVSVFEAVGEFIAGQLDPVDFKEIEKRACPGSGSCGGMYTANTMSAAFEALGMSLPYSSTMANEDAEKLASAAESARVLVEAIKRGLRPRDIVTREAIENAVSVIMATGGSTNAVLHFLAIAHAAEVPWTIDDFERIRRRVPVIVDMKPSGRYLATDLHQAGGIPQVMKLLLDAGLLHGACVTITGQTIAEVLENVPAAPRADQGVIRTLSDPLYAEGHLAILRGNLSPEGCVAKISGLKNPAITGPARVFDSEDDAMAAIMARRIVEGDVVVIRYEGPKGGPGMREMLAPTSALVGQGLGESVGLITDGRFSGGTWGMVVGHVSPEAFVGGPIALVREGDSVTIDAHRQLVQLNVGDEELARRAADWTPPSPRYTRGVLAKFAKFASSASKGAVTDLDL

SEQ ID NO: 333 - DNA, 1674 bp, Burkholderia phymatum
atgccgtacaaccgtcgttcgaagaacatcacgcaaggcgtcgcgcgttcgccgaaccgctcgatgtattacgcgctcggctaccagaaggcagacttcgacaagccgatgatcggcatcgccaacggccactcgaccatcacgccgtgcaacgcgggcctgcaacgactcgccgacgccgccgtcgaagccgtcaagcgcagcgatgcgaatccgcagaccttcggtacgccgaccatttcggacggcatgtcgatgggcacggagggcatgaagtactcgctcgtgtcgcgcgaagtgatcgccgactgcatcgagacctgcgtgcaggggcaatggatggacggcgtcgtcgtgatcggcggctgcgacaagaacatgccgggcggcatgatcggcctcgcgcgaatgaacgtgccaggcatctacgtgtacggcgggaccatcaagccgggcaactggaaaggcaccgacctgactatcgtgtcgtcgttcgaggcagtgggcgaattcacggcgggccgcatgtcgcaagaagacttcgaaggggtcgaacagaacgcctgcccgagcacgggctcgtgcggcggcatgtacacggccaacacgatgagctcgtcgttcgaagcgctcggtatgtcgctgctgtactcgtcgacaatggcgaacccggatcaggagaaagtggattcggcggccgagtcggcgcgcgtgctggtcgaagccgtcaagcaggatctcaagccgcgcgacatcattacgaagaagtcgatcgaaaacgccgttgcgctgatcatggcgacgggcggctcgacgaacgccgtgctgcactatctggccattgcgcacgcggcggaagtggactggtccatcgaagatttcgagcgcatgcgcaagaaagtgcccgtcatctgcgatctcaagccgtcgggcaagtatgtcgccaccgatctgcacaaggccggcggcatcccgcaggtgctgaagctgctgctcgatgcaggcctgctgcacggcgactgcatcacgatcacgggcaagacgatcgccgaagagctgaaggacgtgccagccaaaccgcgcgcggaccagaaggtgatctatccgatcgacaaggcgctttacagcgaaggccatctcgcgattctcaagggcaacctcgcggaagacggcgcggtcgcgaagatcaccgggctgaagaaccccgtcatcacagggcccgcacgcgtgttcgacgacgagcaaagtgcgatggaagccatcctcgccgaccagatcaaggcaggcgatgtcgtcgtgctgcgctatctcggcccgcaaggcggccccggcatgccggaaatgctggcgccgacctcggcgatcatcggcaagggtctcggcgaatcggtcggtcttatcacggatgggcgcttctcgggcggcacctggggcatggtggtgggtcacgtcgcgccggaagcgttcgtcggcggcacgatcgcactcgtgcaggaaggcgattcgatcaccatcgacgcccacaagctgctgttgcaactgaacgtcgacgacggcgaactgcagcgccgccgcgccgcatggaagcagcccgcgccgcgctatacgcgcggcgtgctggccaagttcgcggcgctcgcgaagccggccaacaagggcgccgtcaccggctga

SEQ ID NO: 334 - protein, 557 aa, Burkholderia phymatum
MPYNRRSKNITQGVARSPNRSMYYALGYQKADFDKPMIGIANGHSTITPCNAGLQRLADAAVEAVKRSDANPQTFGTPTISDGMSMGTEGMKYSLVSREVIADCIETCVQGQWMDGVVVIGGCDKNMPGGMIGLARMNVPGIYVYGGTIKPGNWKGTDLTIVSSFEAVGEFTAGRMSQEDFEGVEQNACPSTGSCGGMYTANTMSSSFEALGMSLLYSSTMANPDQEKVDSAAESARVLVEAVKQDLKPRDIITKKSIENAVALIMATGGSTNAVLHYLAIAHAAEVDWSIEDFERMRKKVPVICDLKPSGKYVATDLHKAGGIPQVLKLLLDAGLLHGDCITITGKTIAEELKDVPAKPRADQKVIYPIDKALYSEGHLAILKGNLAEDGAVAKITGLKNPVITGPARVFDDEQSAMEAILADQIKAGDVVVLRYLGPQGGPGMPEMLAPTSAIIGKGLGESVGLITDGRFSGGTWGMVVGHVAPEAFVGGTIALVQEGDSITIDAHKLLLQLNVDDGELQRRRAAWKQPAPRYTRGVLAKFAALAKPANKGAVTG

SEQ ID NO: 335 - DNA, 1674 bp, Burkholderia xenovorans
atgccatacaaccgtcgttcgaagaacatcacgcaaggtgtagcgcgttcgccgaatcgctcgatgtactacgcgctcggctacgaaaaagccgacttcgacaagccgatgatcggcatcgccaacggtcactcgaccatcacgccgtgcaacgcgggcctgcagcgtctcgccgatgccgcggtcgccgcgatcaaaggcgccgacgcgaacccacagatcttcggcacgccgacgatctcggacggcatgtcgatgggcaccgagggcatgaagtactcgctggtgtcgcgcgaagtgatttccgactgcatcgagacctgcgtgcaaggccagtggatggacggcgtggtcgtgatcggcggctgcgacaagaacatgccgggcggcatgatcggcatgctgcgcaccaacgtgccgagcatctacgtgtatggcgggacgattcgtccgggcaactggaagggcaccgacctgaccatcgtgtcgtcgttcgaggccgtgggcgaattcaccgccggccggatgtcgcaggaagatttcgaaggggtcgaacagaacgcgtgcccatccaccgggtcgtgcggcggcatgtacaccgccaacaccatgagctcgtcgttcgaagcgctcggcatgtcgctgctgtattcgtccacaatggccaatccggatcaggaaaaagtcgactcggccgccgaatcggcacgcgtgctggtcgaagcggtcaagcaggatctcaagccgcgcgacatcgtgacccgcaagtcgatcgaaaacgccgtggccgtgatcatggccaccggcggctcgaccaatgccgtgctgcactttctcgccatcgcgcatgcggccgaagtggagtggagcatcgaggacttcgagcgcatgcgcaagaaggtgccggtgatctgcaacctgaagccgtcgggccagttcgtggcgaccgatctgcacaaggccggcggcattccgcaagtcatgaagatcctgctcgacgcaggtctgttgcacggcgattgcatcacgatcaccggccgaaccctcgcggaagagttgaaggacgtgccggccaggccgcgcgccgatcagcaggtgattttcccgatcgagcaggcgctgtacaaggaaggccatctcgcgatcctcaagggcaacctggccgtggacggcgcggtcgccaagatcaccggcctgaagaatcccgtgatcaccggcccggcgcgcgtgttcgacgacgagcaaagcgcgctggaagcgattctggccgacaggatcgtcgcgggcgacgtggtggtgctgcgctatctcggcccgaagggcggccccggcatgccggagatgctcgcgccgacctcggcgatcatcggcaagggactcggcgagagcgtggggctcatcaccgacgggcgcttctcgggtggcacgtggggcatggtggtcgggcacgtcgcgccggaagccttcgtgggcggcacgatcgcgttcgtgcaggaaggcgactcgatcaccatcgacgcgcacaagctgctgctgcaactgaatatcgacgacgccgaactggagcgacgccgtgccgcatggcagcagccgaagccgcgctacacacgcggcgtgctggcgaagtactccgcattggctctgccggccaataagggcgccgtgacgggctaa

SEQ ID NO: 336 - protein, 557 aa, Burkholderia xenovorans
MPYNRRSKNITQGVARSPNRSMYYALGYEKADFDKPMIGIANGHSTITPCNAGLQRLADAAVAAIKGADANPQIFGTPTISDGMSMGTEGMKYSLVSREVISDCIETCVQGQWMDGVVVIGGCDKNMPGGMIGMLRTNVPSIYVYGGTIRPGNWKGTDLTIVSSFEAVGEFTAGRMSQEDFEGVEQNACPSTGSCGGMYTANTMSSSFEALGMSLLYSSTMANPDQEKVDSAAESARVLVEAVKQDLKPRDIVTRKSIENAVAVIMATGGSTNAVLHFLAIAHAAEVEWSIEDFERMRKKVPVICNLKPSGQFVATDLHKAGGIPQVMKILLDAGLLHGDCITITGRTLAEELKDVPARPRADQQVIFPIEQALYKEGHLAILKGNLAVDGAVAKITGLKNPVITGPARVFDDEQSALEAILADRIVAGDVVVLRYLGPKGGPGMPEMLAPTSAIIGKGLGESVGLITDGRFSGGTWGMVVGHVAPEAFVGGTIAFVQEGDSITIDAHKLLLQLNIDDAELERRRAAWQQPKPRYTRGVLAKYSALALPANKGAVTG

SEQ ID NO: 337 - DNA, 1674 bp, Burkholderia multivorans
atgtcgtacaaccgtcgctcgaagcacatcacgcaaggcgtcgcccgctcgccgaaccgttcgatgtattacgccctcggctatcagaaggaagatttcgacaagccgatgatcggcatcgccaacgggcattcgacgatcacgccgtgcaacgcggggctgcagcgcctgtccgacgcggccgtcgaggcgatcaaggcggccggcgcgaatccgcagatcttcggcacgcccacgatctcggacggcatgtcgatgggcaccgaagggatgaagtactcgctcgtgtcgcgcgaggtaatcgccgactgcatcgagacctgcgtgcagggccaatggatggacggcgtcgtggtagtcggcggctgcgacaagaacatgccgggcgggatgatcgcgctcgcgcggctgaacgtgccgggcatctacgtgtacggcgggacgatccgccccggccactggaaaggcaaggatctgacgatcgtctcggcgttcgaggcggtcggcgaattcacggccgggcgcatgtcggacgaggatttcgagggcatcgagcgcaacgcgtgcccgacgtcgggctcgtgcggcggcatgtacaccgcgaacacgatgagctcgtcgttcgaggcgctcggcatgtcgctgatgtattcgtcgacgatggcgaaccccgatcaggaaaaggtcgattcggcggccgaatcggcgcgtgtgctcgtcgaagcggtgaagcgcgacctgaagccgcgcgacatcatcacgaagcagtcgatcgagaacgcggtgtcgctgatcatggcgaccggcggctcgaccaatgcggtgctgcactatctcgcgatcgcgcatgcggccgaggtcgactggacgatcgacgacttcgagcggatccgcaagcgcgtgccggtgatctgcgacctgaagccgtcgggccagtacgtcgcgaccgacctgcaccgtgcgggcggcattccgcaggtgctgaagatcctgctcgatgcgggcctgctgcacggcgactgcgtcacgatcaccggccgcacgctcgccgaagagctgaaggacgtgccgtccgtgccgcgcgccgatcagcaggtgatcttcccgatcgagcgcgcgctgtacaaggagggccatctcgcgatcctgaagggcaatctcgccgaggacggcgcggtcgcgaagatcaccggcctgaagaacccggtgatcacgggcccggcgcgcgtgttcgacgacgagcaaagcgcgatggacgcgatcctcggcgacaagatccgcgccggcgacgtgctcgtgctgcgctatctcggcccgcaaggcgggcccggcatgccggaaatgctcgcgccgacgtcggcgatcatcggcaaggggctcggcgaatcggtcggcttcatcaccgacggccgcttctccggcggtacgtgggggatggtcgtcggccacgtcgcgcccgaggcgttcgtcggcggcacgatcgcgctcgtgcaggaaggcgactcgatcacgatcgacgcgcataagctgctgctgcagctgaacgtcgacgatgcggaactcgcgcgccgccgcgccgcatggaagcagccggcgccgcgctacacgcgcggcgtgctcgccaagtatgccgcgctcgcacggccggcgaatcggggtgcggtcacggggtga

SEQ ID NO: 338 - protein, 557 aa, Burkholderia multivorans
MSYNRRSKHITQGVARSPNRSMYYALGYQKEDFDKPMIGIANGHSTITPCNAGLQRLSDAAVEAIKAAGANPQIFGTPTISDGMSMGTEGMKYSLVSREVIADCIETCVQGQWMDGVVVVGGCDKNMPGGMIALARLNVPGIYVYGGTIRPGHWKGKDLTIVSAFEAVGEFTAGRMSDEDFEGIERNACPTSGSCGGMYTANTMSSSFEALGMSLMYSSTMANPDQEKVDSAAESARVLVEAVKRDLKPRDIITKQSIENAVSLIMATGGSTNAVLHYLAIAHAAEVDWTIDDFERIRKRVPVICDLKPSGQYVATDLHRAGGIPQVLKILLDAGLLHGDCVTITGRTLAEELKDVPSVPRADQQVIFPIERALYKEGHLAILKGNLAEDGAVAKITGLKNPVITGPARVFDDEQSAMDAILGDKIRAGDVLVLRYLGPQGGPGMPEMLAPTSAIIGKGLGESVGFITDGRFSGGTWGMVVGHVAPEAFVGGTIALVQEGDSITIDAHKLLLQLNVDDAELARRRAAWKQPAPRYTRGVLAKYAALARPANRGAVTG

SEQ ID NO: 339 - DNA, 1686 bp, Burkholderia cenocepacia
atggagctccccatgtcgtacaaccgccgctctaagaacatcacgcaaggcgtggcccgttcgccgaaccgctcgatgtattacgccctcggctaccagaaggacgatttcgataaaccgatggtcggtatcgcgaacggccactcgacgatcacgccgtgcaattccggcctgcagcgcctgtcggacgcggccgtggatgccgtgaaggcggccggcgcgaacccgcagatcttcggcacgccgacgatttcggacggcatgtcgatgggcaccgaagggatgaagtactcgctcgtgtcgcgcgaagtgatcgccgactgcatcgagacctgcgtgcagggccagtggatggacggcgtggtggtggtcggcggctgcgacaagaacatgcccggcggcatgatcgcgctcgcacgcctgaacgtgccgggcatctacgtgtacggcggcacgatccgcccgggcaactggaagggccgcgacctgacgatcgtgtcgtcgttcgaggccgtcggcgaattcaccgcgggccggatgtcgcaggaagacttcgaaggcgtcgagaagaacgcgtgcccgacgtcgggttcgtgcggcggcatgtacaccgcgaacacgatgagttcgtcgttcgaggcgctcgggatgtcgctgctgtattcgtcgacgatggcgaaccccgaccaggaaaaagtcgattcggccgccgaatcggcacgcatgctggtcgaggcggtgaagcgcgacctgaagccgcgcgacatcatcacgaaggaatccatcgagaacgcggtgtcggtgatcatggccaccggcggctcgaccaatgcggtgctgcactatctcgcgatcgcgcacgcggccgaagtcgactggacgatcgacgacttcgagcgcattcgcaagcgcgtgccggtgatctgcgacctgaagccgtcgggacaatacgtcgcgaccgacctgcaccgggccggcgggattccgcaggtgctgaagatcctgctcgatgcagggctgctgcacggcgactgcatgacgatcaccggccgcacgatcgccgacgagctgaaggacgtgccggccgtgccgcgcgcggaccagcatgtgatcttcccgatcgaccgcgcactgtacaaggaaggccacctcgcgatcctgaagggcaatctcgcggaagacggcgcggtcgcgaagatcaccggcctgaagaacccggtgatcacgggcccggcgcgcgtgttcgacgacgaacagagcgcaatggacgcgatcctcggcgaccggattcgcgcgggcgacatcctcgtgctgcgctacctcggcccgcagggtggccccggcatgccggaaatgctcgcgccgacttccgcgatcatcggcaaggggctcggcgaatcggtcggcttcatcacggacggacgcttctcgggcggcacttggggcatggtggtcggccacgtcgcgccggaggcgttcgtcgggggcacgatcgcgctggtgcaggaaggcgattcgatcacgatcgacgcgcaccggctgctgctgcaactgaacgtcgacgaggcggaactcgcacggcgccgtgccgcgtggcgacagccggcgccgcgctatacgcgcggggtgctcgcgaaattcgcggcgctcgcccgaccggcgaaccagggagcggtcacgggttga

SEQ ID NO: 340 - protein, 561 aa, Burkholderia cenocepacia
MELPMSYNRRSKNITQGVARSPNRSMYYALGYQKDDFDKPMVGIANGHSTITPCNSGLQRLSDAAVDAVKAAGANPQIFGTPTISDGMSMGTEGMKYSLVSREVIADCIETCVQGQWMDGVVVVGGCDKNMPGGMIALARLNVPGIYVYGGTIRPGNWKGRDLTIVSSFEAVGEFTAGRMSQEDFEGVEKNACPTSGSCGGMYTANTMSSSFEALGMSLLYSSTMANPDQEKVDSAAESARMLVEAVKRDLKPRDIITKESIENAVSVIMATGGSTNAVLHYLAIAHAAEVDWTIDDFERIRKRVPVICDLKPSGQYVATDLHRAGGIPQVLKILLDAGLLHGDCMTITGRTIADELKDVPAVPRADQHVIFPIDRALYKEGHLAILKGNLAEDGAVAKITGLKNPVITGPARVFDDEQSAMDAILGDRIRAGDILVLRYLGPQGGPGMPEMLAPTSAIIGKGLGESVGFITDGRFSGGTWGMVVGHVAPEAFVGGTIALVQEGDSITIDAHRLLLQLNVDEAELARRRAAWRQPAPRYTRGVLAKFAALARPANQGAVTG

SEQ ID NO: 341 - DNA, 1686 bp, Burkholderia mallei
atggagttccccatgtcgtacaaccgccgctcgaagaacatcacgcaaggcgtggcccgttcgccgaaccgctcgatgtattacgcgctcggctatcagaaggaagatttcgacaagccgatgatcggcatcgcgaacggccactcgacgatcacgccgtgcaacgcgggcctgcagcgtctgtcggacgccgccgtcgcggccgtcaaggacgccggcgcgaatccgcagatcttcggcacgccgacgatctcggacggcatgtcgatgggcaccgaagggatgaagtactcgctcgtgtcgcgcgaggtgatcgccgattgcatcgagacctgcgtgcagggccaatggatggacggcgtcgtcgtcgtgggcggctgcgacaagaacatgccgggcggcatgatcgcgctcgcgcggatcaacgtgccgggcatctacgtgtacggcggcacgatccgccccggccactggaaaggccacgacctgacgatcgtgtcgtcgttcgaggcggtcggcgagttcaccgccggacgcatgtcgcaggaggatttcgaaggggtcgaaaagaacgcgtgcccgacgacgggctcgtgcggcggcatgtataccgcgaacacgatgagctcgtcgttcgaggcgctcggcatgtcgctgctgtactcgtcgacgatggccaatcccgatcaggagaaggtcgattcggcggcggaatcggcgcgcgtgctggtcgaggcggtgaagaaggacctgaagccgcgcgacatcatcacgaagcagtcgatcgagaacgcggtgtcggtcatcatggccacgggcggctcgaccaacgcggtgctccactatctggcgatcgcgcacgcggccgagatcgactggtcgatcgaggatttcgagcgcatcaggaagcgcgtgccggtgatttgcgacctgaagccgtcgggccagtacgtcgcgaccgatctgcacgcggcgggcggcattccgcaggtgatgaagctgctgctcgacgcgggcctgctgcacggcgactgcatgacgatcacgggccgcacgctcgccgaggagctgaaggacgtgccgagcgtgccgcgcgccgatcagaaggtgatccatccgatcgaccaggcgctgtacaaggaaggccacctcgcgatcctgaagggcaacctcgccgaggacggcgcggtcgcgaagatcaccggcctgaagaacccggtcatcaccggcccggcgcgcgtgttcgacgacgagcagagcgcgctcgccgcgatcctcgacgacaggatccgcgcgggcgacgtcgtcgtgctgcgctacctcggcccgcaaggcggcccggggatgcccgagatgctcgcgccgacatcggcgatcatcggcaagggcctcggcgaatcggtcggcctgatcaccgacggccgcttctccggcggcacgtgggggatggtggtcggccacgtcgcgccggaagcgttcgtcggcggcacgatcgcgctcgtgcaggaaggcgattcgatcacgatcgacgcgcacaagctgctgctgcaattgaacgtcgacgacgccgaactcgcgcgccgccgcgccgcatggaagcagccggcgccgcgctacacgcgcggcgtgctcgcgaagtacgcggcgctcgcccgcccggcgaaccagggcgccgtcacgggctga

SEQ ID NO: 342 - protein, 561 aa, Burkholderia mallei
MEFPMSYNRRSKNITQGVARSPNRSMYYALGYQKEDFDKPMIGIANGHSTITPCNAGLQRLSDAAVAAVKDAGANPQIFGTPTISDGMSMGTEGMKYSLVSREVIADCIETCVQGQWMDGVVVVGGCDKNMPGGMIALARINVPGIYVYGGTIRPGHWKGHDLTIVSSFEAVGEFTAGRMSQEDFEGVEKNACPTTGSCGGMYTANTMSSSFEALGMSLLYSSTMANPDQEKVDSAAESARVLVEAVKKDLKPRDIITKQSIENAVSVIMATGGSTNAVLHYLAIAHAAEIDWSIEDFERIRKRVPVICDLKPSGQYVATDLHAAGGIPQVMKLLLDAGLLHGDCMTITGRTLAEELKDVPSVPRADQKVIHPIDQALYKEGHLAILKGNLAEDGAVAKITGLKNPVITGPARVFDDEQSALAAILDDRIRAGDVVVLRYLGPQGGPGMPEMLAPTSAIIGKGLGESVGLITDGRFSGGTWGMVVGHVAPEAFVGGTIALVQEGDSITIDAHKLLLQLNVDDAELARRRAAWKQPAPRYTRGVLAKYAALARPANQGAVTG

SEQ ID NO: 343 - DNA, 1674 bp, Ralstonia eutropha
atggcattcaacaaacgctcccgcaacatcacgcaaggtgtggcgcgttccccgaaccgctcgatgtactacgccctgggctaccagaaggaagacttcgacaagcccatggtcggcatcgccaacggccactcgacgatcacgccgtgcaacgccggcctgcagcgcctggccgacgccgcgatcgacgccgtgaaggcctcggacgccaatccgcaggtattcggcacgccgacgatctccgacggcatgtcgatgggcaccgagggcatgaagtactcgctgatctcgcgcgaagtcattgccgactgcatcgagaccgccgcccagggccagtggatggacggcgtggtggtgatcggcggctgcgacaagaacatgccgggcggcatgatcgcgctcgcgcgcaccaatgtgccgggcatctacgtctatggcggcaccatcaagcccggcaactggaagggcaaggacctgaccatcgtgtcgtcgttcgaggccgtgggcgaattcaccgccggccgcatgagcgaagaagatttcgagggcgtggaaaggaacgcttgtccgtcgaccggatcgtgcggcggcatgtacaccgccaatacgatgagctcgtcgttcgaggcgcttgggatgtcgctgctgtattcgtcgacgatggccaaccccgatcaggaaaaggtcgatagcgctgccgaatcggcgcgcgtgctggtcgaggcgatcaagaaggacatcaagccgcgcgacatcatcacgcgcaagtcgatcgaaaacgccgtcgcgctgatcatggccaccggtggctcgaccaacgcggtgctgcactacctggccattgcgcactcggccgaagtcgaatggaccatcgacgatttcgagcgcatccgtcgcaaggtgcctgtgatctgcaacctgaagccgtcgggccagtacgtggccaccgacctgcacaaggcgggcggcatcccgcaggtcatgaagatcctgctgaaggccggactgctgcatggcgactgcctgaccatcacaggccgcacgctggctgaagagctggaacacgtgccggaccagccgcgggccgaccaggacgtgatcatgccaatcgagaaggcgctctatgcggaggggcatctggcgatcctgaagggcaatctcgccgaggaaggcgcggtggccaagatcaccggcctgaagaatccggtcatcaccgggccggcgcgggtgttcgaggatgaacagagcgcgatggaggcgatcctggccgacaagatcaatgcgggggatgtgctggtgctgcgctatcttgggcccaagggcgggcccgggatgccggaaatgctggcgcctacgtcagccattattggcaaggggttgggagagtcggtgggcttcatcaccgatggccggttctccgggggcacctgggggatggtcgtcggccatgtcgcgccggaagcgtatgtaggcggcaatattgcgctcgtgcgggaaggggattcgatcacgatcgatgcgcacaagctggtgttgcaggtgaatgtgtcggatgaggagttggctcgccgccgggctgagtggaaacaacctgttgcgcgttatacacggggggtattggccaagtttgctcgactggcgtcgacggccagtaagggggcggtgacggattga

SEQ ID NO: 344 - protein, 557 aa, Ralstonia eutropha
MAFNKRSRNITQGVARSPNRSMYYALGYQKEDFDKPMVGIANGHSTITPCNAGLQRLADAAIDAVKASDANPQVFGTPTISDGMSMGTEGMKYSLISREVIADCIETAAQGQWMDGVVVIGGCDKNMPGGMIALARTNVPGIYVYGGTIKPGNWKGKDLTIVSSFEAVGEFTAGRMSEEDFEGVERNACPSTGSCGGMYTANTMSSSFEALGMSLLYSSTMANPDQEKVDSAAESARVLVEAIKKDIKPRDIITRKSIENAVALIMATGGSTNAVLHYLAIAHSAEVEWTIDDFERIRRKVPVICNLKPSGQYVATDLHKAGGIPQVMKILLKAGLLHGDCLTITGRTLAEELEHVPDQPRADQDVIMPIEKALYAEGHLAILKGNLAEEGAVAKITGLKNPVITGPARVFEDEQSAMEAILADKINAGDVLVLRYLGPKGGPGMPEMLAPTSAIIGKGLGESVGFITDGRFSGGTWGMVVGHVAPEAYVGGNIALVREGDSITIDAHKLVLQVNVSDEELARRRAEWKQPVARYTRGVLAKFARLASTASKGAVTD

SEQ ID NO: 345 - DNA, 1674 bp, Ralstonia metallidurans
atggcttacaacaaacgttcccagcacatcacgcaaggcgtggcgcgctcccccaaccgttcgatgtactacgcgctcggctacaagaaggaagacttcgacaagccgatggtgggtatcgccaacggccactcgacgatcaccccctgcaacgccggcctgcagcgcctggcggacgcggccgtggatgcgatcaaggcctcggacgccaacccgcagatcttcggcacgccgacgatctccgacggcatgtcgatgggcaccgagggcatgaagtactcgctgatctcgcgtgaagtcattgccgactgcatcgaaaccgctgcccagggccagtggatggacggcgtggtcgtgatcggcggctgcgacaagaacatgcccggcggcatgatcgcactggcgcgcaccaacgtgccgggcatctacgtctacggcggcaccatccgcccgggtaactggaagggcaaggacctgaccatcgtgtcgtcgttcgaggccgtgggcgaattcaccgccggccgcatgagcgaggaagacttcgagggcgtggagaagaacgcctgcccgagcaccggctcgtgcggtggcatgtacaccgccaacacaatgagctcgtcgttcgaggcgctgggcatgtcgctgctgaattcgtcgacgatggccaacccggaccaggaaaaggtggacagcgccgccgaatcggcccgcgtgctggtggaagccatcaagaaggacatcaagccgcgcgacatcatcacgcgcaaatcgatcgagaacgccgtgacgctgatcatggccacgggcggttccaccaacgcggtactgcattacctggccatcgcccactcggccgaagtggaatggaccatcgacgatttcgagcgcatccgccgccgcgtgccggtgatctgcaacctgaagccgtcgggcgcctacgtggccaccgacctgcaccgcgccggtggcattccgcaagtgatgaagatcctgctgaacgccggtctgctgcatggcgactgcctgacgatcacgggccgcacgctggccgaggagctcgagcacgttcccaatgagccgcgtaccgaccaggacgtgatcctgccgatctcgcaggccctgtacaagcaaggccacctggccatcctgaagggcaacctcgccgaggaaggcgcagtggccaaaatcaccggcctgaagaacccggtcatcaccggcccggcccgcgtgttcgaggacgaacagagcgccatggaagcgatcctggcggacaagatcaacgctggcgacatcctggtgctgcgctaccttggcccgaagggcggcccgggcatgcctgaaatgctggcgccgacttcggcgatcatcggcaagggtctcggcgaatcggttggtttcatcaccgacggccgcttctcggggggcacctggggcatggtggttggccacgttgcgccggaagcccatgtgggcggtacgattgcactggttcaggaaggcgactcgatcacgatcgacgcgcaccagctgctgctgcaactgaatgtggccgacgacgagctggcccgccgccgcgctgcctggaaacagccggcgccgcgctacacgcgcggcgtactggcgaagttcgcgaggctggcctccacggccagcaagggcgccgtgacggactga

SEQ ID NO: 346 - protein, 557 aa, Ralstonia metallidurans
MAYNKRSQHITQGVARSPNRSMYYALGYKKEDFDKPMVGIANGHSTITPCNAGLQRLADAAVDAIKASDANPQIFGTPTISDGMSMGTEGMKYSLISREVIADCIETAAQGQWMDGVVVIGGCDKNMPGGMIALARTNVPGIYVYGGTIRPGNWKGKDLTIVSSFEAVGEFTAGRMSEEDFEGVEKNACPSTGSCGGMYTANTMSSSFEALGMSLLNSSTMANPDQEKVDSAAESARVLVEAIKKDIKPRDIITRKSIENAVTLIMATGGSTNAVLHYLAIAHSAEVEWTIDDFERIRRRVPVICNLKPSGAYVATDLHRAGGIPQVMKILLNAGLLHGDCLTITGRTLAEELEHVPNEPRTDQDVILPISQALYKQGHLAILKGNLAEEGAVAKITGLKNPVITGPARVFEDEQSAMEAILADKINAGDILVLRYLGPKGGPGMPEMLAPTSAIIGKGLGESVGFITDGRFSGGTWGMVVGHVAPEAHVGGTIALVQEGDSITIDAHQLLLQLNVADDELARRRAAWKQPAPRYTRGVLAKFARLASTASKGAVTD

SEQ ID NO: 347 - DNA, 1674 bp, Ralstonia solanacearum
atgccagacaacaagcgttcccagcacatcacccagggcgtggcacgctcgcccaaccgctcgatgtactacgcgctgggctaccagaaagaagacttcaacaatccgatgatcggcgtggccaacggccattcgaccatcacgccgtgcaactcgggcctgcagaaactggccgacgcggccgtggccgccgtcaaggcatcgaacgccaacccgcagatcttcggcacgcccaccatttccgacggcatgtcgatgggcaccgagggcatgaagtattcgctgatctcgcgcgaggtcatcgccgactgcatcgagacctgcgcacaaggccagtggatggacggcgtggtcgtgatcggcggctgcgacaagaacatgcccggcggcatgatcgcgctggcacgcaccaacgtgccgggcatctacgtgtacggcggcaccatccggccggggcactggaagggcaaggacctgaccatcgtgtcgtcgttcgaggccgtgggcgagttcaccgccggccgcatgagcgacgaagacttcgagggcatcgagaagaacgcctgcccgtcgagcggctcgtgcggcggcatgtacaccgccaacacgatgagctcgtcgttcgaggcgctgggcatgtcgctgctgtattcgtcgaccatggccaaccccgaccaggagaaggtcgacagcgccgccgaatcggcccgcgtgctggtcgaggccgtgcgccgcgacctcaagccgcgcgacatcatcacgcgcaagtcgatcgagaacgccgtggccgtcatcatggcgaccggcggctcgaccaacgccgtgctgcactacctggccatcgcccatgccgccggcgtggaatggaccatcgatgacttcgagcgcgtgcgccagcgcgtgcccgtgatctgcaacctgaagccgtcgggccagtatgtcgccaccgacctgcaccgcgcgggcggcatcccgcaggtgatgaagatcctgctgaacgcgggcctgctgcacggcgactgcatcaccatcaccggcaagacgctggccgaggaactcgccaacgtgcccgaccagccgcgcgcggaccaggacgtgatcctgccgctcgacaaggcgctctaccagcagggccacctcgccatcctcaagggcaacttggccgaggaaggcgccgtggcgaagatcaccggcctgaagaacccggtcatcaccggcccggcgcgcgtgttcgacgatgagcagagcgcgatggaagccatcctgggcgacaaaatcaacgccggcgacgtgctggtgctgcgctacctcggtccgaagggcggcccgggcatgccggaaatgctggccccgacgtcggccatcatcggcaagggcctgggcgaatcggtcggcttcatcaccgatggacgcttctcgggcggcacctggggcatggtggtcggccacgtcgcgccggaagccttcgtgggcggcaccatcgccctggtgcaggaaggcgattcgatcaccatcgacgcgcaccagcgcgtgctgcagctgaacgtgccggaagacgaactggcccgccgccgcgccgcgtggcagcagccggcaccgcgctatacgcgcggcgtgctcgccaagttcgctcagttggcgtcgacggccagcaagggcgccgtgaccggctga

SEQ ID NO: 348 - protein, 557 aa, Ralstonia solanacearum
MPDNKRSQHITQGVARSPNRSMYYALGYQKEDFNNPMIGVANGHSTITPCNSGLQKLADAAVAAVKASNANPQIFGTPTISDGMSMGTEGMKYSLISREVIADCIETCAQGQWMDGVVVIGGCDKNMPGGMIALARTNVPGIYVYGGTIRPGHWKGKDLTIVSSFEAVGEFTAGRMSDEDFEGIEKNACPSSGSCGGMYTANTMSSSFEALGMSLLYSSTMANPDQEKVDSAAESARVLVEAVRRDLKPRDIITRKSIENAVAVIMATGGSTNAVLHYLAIAHAAGVEWTIDDFERVRQRVPVICNLKPSGQYVATDLHRAGGIPQVMKILLNAGLLHGDCITITGKTLAEELANVPDQPRADQDVILPLDKALYQQGHLAILKGNLAEEGAVAKITGLKNPVITGPARVFDDEQSAMEAILGDKINAGDVLVLRYLGPKGGPGMPEMLAPTSAIIGKGLGESVGFITDGRFSGGTWGMVVGHVAPEAFVGGTIALVQEGDSITIDAHQRVLQLNVPEDELARRRAAWQQPAPRYTRGVLAKFAQLASTASKGAVTG

SEQ ID NO: 349 - DNA, 1674 bp, Ralstonia pickettii
atgccagacaacaagcgttcccagcacatcactcagggcgtggcgcgctcgcccaaccgctcgatgtactacgcgctgggctacacaaaagacgacttcaacaatccgatgatcggtgtggccaacggccattcgaccatcacgccatgcaactcgggcctgcagaagctggccgatgccgccgtggctgcaataaaggacgcccgcgcgaatccgcagatcttcggcacgcccaccatttccgatggcatgtcgatgggcacggaaggcatgaagttctcgctgatctcgcgcgaagtgattgccgactgcatcgagacctgcgtcaacggccaatggatggacggtgtggtcgtcatcggcggctgcgacaagaacatgccgggcggcatgatcgccctggcgcgcacgaatgtgccgggcatctacgtgtacggcggcaccatcaagccggggcactggaagggcaaggacctgaccatcgtctcgtcgttcgaggccgtgggcgaattcaccgccggccgcatgagcgaggaagacttcgagggcatcgaaaaaaacgcctgcccgtcgagcggttcgtgcggcggcatgtacacggccaacacgatgagttcgtcgtttgaagcgctaggcatgtcgttgctgtattcatcgacgatggccaatcccgatcaggagaaggtcgacagcgccgccgaatccgctcgcgtgttggttgatgccgtgcgccgcgacctgaagccgcgcgacatcatcacgcgcaagtccatcgagaacgctgtcgccgtcatcatggcaaccggtggctcgaccaacgccgtgctgcactacctggccatcgctcacgctgcggaagtggaatggacgatcgacgacttcgagcgggtgcgccagcgcgtgcccgtcatctgcaacctcaagccgtcgggccagtacgtggccaccgacctgcacgaggccggcggcatcccgcaggtgatgaagctgctgctcaacgccggcctgctgcatggcgattgcatcaccatcaccggcaagacgctggcggaagaactcgcccacgtgcccgaccagccgcgcgctgatcagaacgtgatcctgccgattgacaaggcgctctacaaggaaggccacctcgccatcctgaagggcaatctggccgaagaaggcgccgtggcgaagatcaccgggctgaagaatcccgtcatcaccggcccggcccgcgtgttcgaggacgagcaaagtgcgatgagcgcgatcctgggcgaccagatcaaggccggcgatattctggtgctgcgctatctggggccgaagggcggccccggcatgccggagatgctggccccgacctcggccatcatcggcaagggcctgggcgagtcagtcggcttcattaccgacggacgcttctcgggcggtacgtggggcatggtggtcggccacgtcgcaccggaagcctacgtgggaggcacgattggattggtgcacgaaggggattcgatcaccatcgacgcgcaccagcggctgctgcaattgaacgtgccggacgacgagcttgcccgccgccgcgccgcgtggaagcaacctgcgccgcgctatacgcgtggcgtgctggcgaagtttgcaaaactggcagcaacggccagcaagggtgcggtaacggactga

SEQ ID NO: 350 - protein, 557 aa, Ralstonia pickettii
MPDNKRSQHITQGVARSPNRSMYYALGYTKDDFNNPMIGVANGHSTITPCNSGLQKLADAAVAAIKDARANPQIFGTPTISDGMSMGTEGMKFSLISREVIADCIETCVNGQWMDGVVVIGGCDKNMPGGMIALARTNVPGIYVYGGTIKPGHWKGKDLTIVSSFEAVGEFTAGRMSEEDFEGIEKNACPSSGSCGGMYTANTMSSSFEALGMSLLYSSTMANPDQEKVDSAAESARVLVDAVRRDLKPRDIITRKSIENAVAVIMATGGSTNAVLHYLAIAHAAEVEWTIDDFERVRQRVPVICNLKPSGQYVATDLHEAGGIPQVMKLLLNAGLLHGDCITITGKTLAEELAHVPDQPRADQNVILPIDKALYKEGHLAILKGNLAEEGAVAKITGLKNPVITGPARVFEDEQSAMSAILGDQIKAGDILVLRYLGPKGGPGMPEMLAPTSAIIGKGLGESVGFITDGRFSGGTWGMVVGHVAPEAYVGGTIGLVHEGDSITIDAHQRLLQLNVPDDELARRRAAWKQPAPRYTRGVLAKFAKLAATASKGAVTD

SEQ ID NO: 351 - DNA, 1689 bp, Limnobacter sp.
atgagcatcaatcgacgttccaagaacattacccagggcgtggcccgttcgcccaaccgcgcgatgtatttcgccatgggttacaaagacgaagacttcaataaccccatgattggcattgccaatggccattccacgatcacgccttgcaacagcggcttgcagcctttggcagatgcggctgtgaaagcagtgaaagaggctggtggcaatccacaaattttcggcacccccaccatctccgatggcatgagcatgggcaccgaaggcatgaagtattcactggtcagccgcgaggtcatcgcggactgcatcgaaactgcggtacagggccagtggatggacggcgtgttggtgatcggcggctgcgacaagaacatgcccggcggcatgatcggcatggcccgcatgaacgtgccaggcatttacgtttatggcggcactatcaagccggggcgttacaaaggcaaagacctgaccattgtgtctgccttcgaagccgtgggcgaattcacggctggccgcatgagcgaggaagacttcaagggtatagagaagaacgcctgcccgagttccggttcctgtggtggcatgtacaccgccaacaccatgagctcggcattcgaagctttgggcatgagcctgccctactccagcaccatgtcgaacattgacgcagagaaagtcacttcaactgaagagtccgctcgcgtcttgatcgaagcggttcgcaacgacttgaagccccgcgacatcatcaccaagaagtcgattgaaaatgctgtggccgtgctgatggccaccggtggttccaccaacgcggtactgcacttcctggccattgcaaaagcagcagatgtggcctggagctacgaagactttgaacgcgtgcgcttgcgcacaccagtcatttgcaacctgaagccttctggccaatacgttgccactgacctgcacgatgccggtggtattccacaagtcatgaaaattttgttggatgcgggcctgttgcatggcgattgcatcaccatcactggcaaaaccattgcagaaaccctggccgatattccttcagtgccccgcgcggatcaaaacgtgatcatgccgatcgaaaaagccctgtacaagcaaggccacttggcgattctgaaaggcaacctggcacccgaaggtgctgtggccaagatcacaggcctcaaaaaccctgtaattaccggaccagccaaggtttttgacgacgagcaaagcgcgatggacgcaattttgggcgacaagatcaaagacggcgacgtgattattcttcgctacttgggccccaaaggcggtccaggcatgccggaaatgttggccccaacctcggcaattattggcaagggcttgggagaaacagtcggcctgatcaccgacggccgcttttccggtggcacctggggtatggtggtcggccacgttgcgccagaggcctacgttggcggcccgatcgcgctgatcaaggaaggtgactccatcacgatggacgcacatcagaaattgttacagatcaacgtgagcgaggaagaactggcgaagcgtcgtgaaagttgggtaaaacccaagccacgctacaccactggtgtgctggccaaattcgcagccttggccagtagcgccagcaagggtgcagtcaccgatggcgatctcgacctctaa

SEQ ID NO: 352 - protein, 562 aa, Limnobacter sp.
MSINRRSKNITQGVARSPNRAMYFAMGYKDEDFNNPMIGIANGHSTITPCNSGLQPLADAAVKAVKEAGGNPQIFGTPTISDGMSMGTEGMKYSLVSREVIADCIETAVQGQWMDGVLVIGGCDKNMPGGMIGMARMNVPGIYVYGGTIKPGRYKGKDLTIVSAFEAVGEFTAGRMSEEDFKGIEKNACPSSGSCGGMYTANTMSSAFEALGMSLPYSSTMSNIDAEKVTSTEESARVLIEAVRNDLKPRDIITKKSIENAVAVLMATGGSTNAVLHFLAIAKAADVAWSYEDFERVRLRTPVICNLKPSGQYVATDLHDAGGIPQVMKILLDAGLLHGDCITITGKTIAETLADIPSVPRADQNVIMPIEKALYKQGHLAILKGNLAPEGAVAKITGLKNPVITGPAKVFDDEQSAMDAILGDKIKDGDVIILRYLGPKGGPGMPEMLAPTSAIIGKGLGETVGLITDGRFSGGTWGMVVGHVAPEAYVGGPIALIKEGDSITMDAHQKLLQINVSEEELAKRRESWVKPKPRYTTGVLAKFAALASSASKGAVTDGDLDL

SEQ ID NO: 353 - DNA, 1674 bp, Herminiimonas arsenicoxydans
atggcattcaatcgccgctcgaaaaacatcacgcaaggcgtgtcccgcagtcctaaccgttccatgtattacgccatgggttacgaaaaggccgatttcgacaagcctatggtcggcatcgccaacggtcactcgacgattacgccatgtaactccggcctgcaaaaactggccgatatcgcgatcaagaccatcaaggatgcaggcggcaatccgcaagtgttcggtacgccgacgatttccgacggcatgtccatgggcaccgaaggcatgaagtattcgctgatttcgcgcgaagtcattgccgactgtatcgaaaccgcagtcaacggccaatggatggatggcgtgctggtcatcggcggctgcgacaagaatatgccgggcggcatgatcgccatgttgcgcaccaacgtgcctagtatttatgtctacggcggcaccatcaagccggggcactggaaaggcaaagacctgaccatcgtttccgcgtttgaagcggtcggcgaattcactgccggccgcatgtcacaagaagattttgacggcatcgaacgcaatgcctgcccatcatccggttcctgcggcggcatgtatacagccaataccatgtcgtcctcgttcgaggcgctgggcctggccttgccttactcgtcgacgatggccaatcctgacgatgaaaaagtcggctccgcagcggaatccgcgcgcgtgctgatcgaagcaatcaagaaggatctgaagccgcgcgacatcgtgacacgcaaggctatcgaaaacgcagtggccgtcatcatggcaaccggcggttcgaccaatgccgtgctgcacttcctggcgattgcgcacgctgcagaaatcgactggaccatcgacgacttcgaacgcatgcgcaaaaaagtccctgtcatctgcgatctgaaaccatccggcaaatacgtggcaaccgatctgcataaggccggcggcattccgcaagtgatgaaggtgttgctcgacgccggcttgttgcacggtgattgcatgacgatcaccggccagaccgttgcagaagcgctggcgcacatcccgtcggtaccaagtgccgaccaggacgtgatccacaccatcgacaaggctttgtacgcacaaggtcaccttgcaatcctgaagggcaatctgtcgcctgaaggttgcgtggcaaaaatcaccggtctgaaaaatcctgtcatcaccggacctgcacgcgtatttgacgacgaatactcggcaatggacgccatcatggcgaaccagatcaaggccggcgacgtactcgtcatgcgctacctcggacctaaaggcggcccgggcatgccggaaatgctggcaccgacttccgcactggtcggtcagggtctgggtgagtcagtcggcttgattaccgatggccgtttctccggcggtacctggggcatggtggttggccacgtttcgccggaagcgtttgtcggcggtaccatcggtctggtggaagaaggcgattccgtcaccatcgatgcgcgtcaattgctgattcagttgaacgtatcggaagaggaaatcgcacgccgtcgcgccaactggaagcagcctgcaccgcgttacacacgtggcgtgctggcaaaatatgcagctctggcatcgacggcaagcaaaggcgctgtcaccggctga

SEQ ID NO: 354 - protein, 557 aa, Herminiimonas arsenicoxydans
MAFNRRSKNITQGVSRSPNRSMYYAMGYEKADFDKPMVGIANGHSTITPCNSGLQKLADIAIKTIKDAGGNPQVFGTPTISDGMSMGTEGMKYSLISREVIADCIETAVNGQWMDGVLVIGGCDKNMPGGMIAMLRTNVPSIYVYGGTIKPGHWKGKDLTIVSAFEAVGEFTAGRMSQEDFDGIERNACPSSGSCGGMYTANTMSSSFEALGLALPYSSTMANPDDEKVGSAAESARVLIEAIKKDLKPRDIVTRKAIENAVAVIMATGGSTNAVLHFLAIAHAAEIDWTIDDFERMRKKVPVICDLKPSGKYVATDLHKAGGIPQVMKVLLDAGLLHGDCMTITGQTVAEALAHIPSVPSADQDVIHTIDKALYAQGHLAILKGNLSPEGCVAKITGLKNPVITGPARVFDDEYSAMDAIMANQIKAGDVLVMRYLGPKGGPGMPEMLAPTSALVGQGLGESVGLITDGRFSGGTWGMVVGHVSPEAFVGGTIGLVEEGDSVTIDARQLLIQLNVSEEEIARRRANWKQPAPRYTRGVLAKYAALASTASKGAVTG

SEQ ID NO: 355 - DNA, 1785 bp, Bordetella parapertussis
atgtccgataataaccggcgagcgtgttgttccgtagcgctgccttccgacagcgatctggccggcccggcatgggcctacgcacctggagacaagaccatgtccgacaacaatcgttcccgtcacattaccgagggcgtggcgcgcgcgcccaatcgggccatgtactacgcgctgggctacaccgaggcggatttccagaatccgatgatcggcgtggccaacggacattccacgatcactccatgcaacagcgggctgcagcgcctggccgacgcggcgatcgaggccatccgcgtctcccgcgccaacccccaggtgttcggcacgccgacgatttccgatggcatgtccatgggcaccgaaggaatgaagtattcgctggtgttgcgcgaggtcatcgccgactgcatcgagaccgccgcgcaggggcagtggatggatggcgtggtggtcatcggcggatgcgacaagaacatgcccggcggcatgatggcgctcgcgcgcatgaatgtgcccggcatctacgtgtatggcggcaccatcaagcccggccactacaagggcaaggacctgaccatcgtatcggtgttcgaagccgtcggcgaatacaccatgggccgcatggacgaaaccgacttcaaggccatcgagcaatgcgccatccccgggtcgggttcctgcggcggcatgtacacggccaacaccatgagctcggccttcgaggccatggggatgagcctgcctcattccagcaccatggccaacgaggaccaggagaaagtcgcgtcggcggcggaatcggcgcgcgtgctggtcgaggcggtgcggcgccagctgcggccgcgcgacatcatcacccgcgcttccatcgagaacgccgtggcggtgatcatggccacgggcggctcgaccaacgccgtgctgcacttcctcgccatcgcccacgcggcggaagtgccgtggaacatcgacgacttcgagcgcatccgcaagcgcgtgccggtcatctgcgatctcaagccgtccggcaagtacgtggcgaccgacctgcatcgcgccggcggcatcccacaagtgatgaagatcctgctgaacgccggcctgttgcatggcgattgcatcaccatcaccggcaagaccgtggccgagacgctggcgaacgtacccgatgcgccgccgcccgggcaggacgtcatcatgcccatcgaacgcgcgttctacccgcaggggcacctggcgatactcaagggcaatctttcgccggaaggctgcgtggccaagatcaccgggttgaagaatccggtcattaccggcccggcgcgcgtgttcgattccgaagacgatgccatgtccgccatcatggaccgccgcatccgcgatggcgatgtggtggtgatccgctacgagggccccaagggcggtccaggcatgcgcgagatgctcgcgcccacttccgcgctggtcggccaggggttgggcgaaaccgtcggcctgatcaccgacgggcggttttccggcggcacctggggcatggtggtcgggcacgtggcgcccgaggcgttcgtcggcgggccgatcgcgctgattcgcgagggcgattcggttaccatcgatgcccatcagctgctgctgcagctcaacatcagcgatgaggaaatggcggctcgtcgcaaggcttgggcccagcccaagccgcgctatgtgcgcggcgtgcttgccaagttcggcaagctggcctgtaccgccagccgtggggcagtaaccgatgcatttgaagagtag

SEQ ID NO: 356 - protein, 594 aa, Bordetella parapertussis
MSDNNRRACCSVALPSDSDLAGPAWAYAPGDKTMSDNNRSRHITEGVARAPNRAMYYALGYTEADFQNPMIGVANGHSTITPCNSGLQRLADAAIEAIRVSRANPQVFGTPTISDGMSMGTEGMKYSLVLREVIADCIETAAQGQWMDGVVVIGGCDKNMPGGMMALARMNVPGIYVYGGTIKPGHYKGKDLTIVSVFEAVGEYTMGRMDETDFKAIEQCAIPGSGSCGGMYTANTMSSAFEAMGMSLPHSSTMANEDQEKVASAAESARVLVEAVRRQLRPRDIITRASIENAVAVIMATGGSTNAVLHFLAIAHAAEVPWNIDDFERIRKRVPVICDLKPSGKYVATDLHRAGGIPQVMKILLNAGLLHGDCITITGKTVAETLANVPDAPPPGQDVIMPIERAFYPQGHLAILKGNLSPEGCVAKITGLKNPVITGPARVFDSEDDAMSAIMDRRIRDGDVVVIRYEGPKGGPGMREMLAPTSALVGQGLGETVGLITDGRFSGGTWGMVVGHVAPEAFVGGPIALIREGDSVTIDAHQLLLQLNISDEEMAARRKAWAQPKPRYVRGVLAKFGKLACTASRGAVTDAFEE

SEQ ID NO: 357 - DNA, 1686 bp, Bordetella petrii
atgcccagcaacgaacgttcacgccacatcacgcaaggcgtcgcccgcgcgcccaaccgggccatgtattacgcgctgggctaccaggaagccgatttcgacaaccccatgatcggcgtggccaacggccattccaccatcaccccctgcaacagcggcctgcagcggctggccgacgcggccatcgatgccgtgcgcgcggcccgcgccaatccgcaggtgttcggcacccccaccatatccgacggcatgtcgatgggcaccgagggcatgaaatactcgctggtgtcgcgcgaagtcattgccgactgtatcgagaccgccgtgcagggccagtggatggacggcgtcgtggtcatcggcggctgcgacaagaacatgcccggcggcatgatcgcgctggcccgcatgaacgtgccaggcatctacgtgtatggcggcaccatcaagccgggccgctataaagggcaagatctcactatcgtgtccgtgttcgaagccgtcggtgagtacaccatggggcgcatggacggcgaagatttccgccagatcgaaaaatgcgccattcccggctcgggctcgtgcggcggcatgtacaccgccaacaccatgagttcggccttcgaagccatgggcatgagcctgccgtattccagcaccatggccaacgaagacgacgaaaaaatcgcctcggccgccgagtccgcccgcgtgctggtcgatgccgtgcggcgcgacgtgcggccgcgcgacatcatcacgcgcgaatccatcgaaaacgccgtgtcggtcatcatggccacgggcggctccaccaatgccgtgctccatttcctggccatcgcccacgccgccgaagttcaatggaccatcgacgacttcgagcgcatccgccggcgcgtgccggtcatctgcgacctcaaaccttcgggccgatacgtggccaccgatctgcaccgcgccggcggcgtcccgcaagtcatgaagctgctgctcgctgccggcttgctgcatgggcattgcatgaccatcaccggcaagaccatcgccgaaacgctcgccgacgtgcccgccgagccgccggccggccaggatgtcatccggcctatcggccgcgcgctgtacccgcagggccatctggccatcctcaagggcaacctgtcgcccgagggctgcgtggccaagatcacgggcctgaagaatcccgtcatcaccggcccggcgcgcgtgttcgattcagaagacgacgccatggccgccatcatggaacggcgcattcgcgctggcgacgtggtggtcatccgctacgaagggcccaagggcggtcccggcatgcgcgaaatgctggcgcccacctcggcgctggtggggcagggcctgggcgaaagcgtcggcctcattaccgatggccgcttctcgggcggcacctggggcatggtcgtgggccatgtcgcgcccgaggcctatgtgggcggccccattgccctgatccgcgaaggcgattcggttaccatcgacgctcaccaattgttgttgcagctcaatatttctgacgacgaaatggcggcgcgccgcaaggcctgggtccagccccggccgcggtacacgcgcggcgtgcttgccaagttcggcaagctggccggcaccgccagtcgcggggcagttaccgatgcatttgaagcatag

SEQ ID NO: 358 - protein, 561 aa, Bordetella petrii
MPSNERSRHITQGVARAPNRAMYYALGYQEADFDNPMIGVANGHSTITPCNSGLQRLADAAIDAVRAARANPQVFGTPTISDGMSMGTEGMKYSLVSREVIADCIETAVQGQWMDGVVVIGGCDKNMPGGMIALARMNVPGIYVYGGTIKPGRYKGQDLTIVSVFEAVGEYTMGRMDGEDFRQIEKCAIPGSGSCGGMYTANTMSSAFEAMGMSLPYSSTMANEDDEKIASAAESARVLVDAVRRDVRPRDIITRESIENAVSVIMATGGSTNAVLHFLAIAHAAEVQWTIDDFERIRRRVPVICDLKPSGRYVATDLHRAGGVPQVMKLLLAAGLLHGHCMTITGKTIAETLADVPAEPPAGQDVIRPIGRALYPQGHLAILKGNLSPEGCVAKITGLKNPVITGPARVFDSEDDAMAAIMERRIRAGDVVVIRYEGPKGGPGMREMLAPTSALVGQGLGESVGLITDGRFSGGTWGMVVGHVAPEAYVGGPIALIREGDSVTIDAHQLLLQLNISDDEMAARRKAWVQPRPRYTRGVLAKFGKLAGTASRGAVTDAFEA

SEQ ID NO: 359 - DNA, 1695 bp, Polaromonas sp.
atggaaaccaagaccattcagctcaacccccgcagcaaaaacatcaccgaaggcaaatcgcgcgcgcccaaccgctcgatgtactacgccatgggctatgaagaggccgacttcaagaagcccatgattggtgtggccaacgggcacagcaccatcaccccctgcaacagcggcctgcaaaagctggcggacgcggccattgccggcattgaagaagccggcggcaacgcccaggtgttcggcacgcccaccatctcggacggcatggccatgggcaccgagggcatgaagtactcgctggtcagccgcgaagtgatctccgactgcatcgaaacctgcgtgcagggccagtggatggacggcgtgctggtgatcggcggctgcgacaagaacatgcccggcggcctgatgggcatgctgcgcgccaacgtgccggccatctacgtctatggcggtaccattttgccgggcagctacaagggcaaagacctcaacatcgtcagcgtgtttgaagccgtcggcgaaaacgcagcaggccgcatgagcgatgaagacctgctgcaaatcgagcgccgcgccattcccggcaccggtagctgcggcggcatgtacacggccaacaccatgtccagcgccttcgaggcgctcggcatttcgctgccctactccagcaccatggccaatccgcacgacgagaaaatgaactcggccagggagtccgccaaggtcctggtcgaagccatcaagaaagacatcaagccgcgcgatctcgtcacgaagaaagccattgaaaacgccgtggcagtgatcatggccacgggcggctccaccaatgccgtgctgcacttcctggcgattgcgcatgccgccggcgtggactggacaatcgacgacttcgaacgcgtgcgccaaagaacgccggtgctgtgcgacctgaagccgtccggcaagtacctggccgtggacctgcaccgcgccggcggcattccgcaggtcatgaagatgctgctggcggccggcctgctgcatggcgactgcctgacgatcaccggccaaaccattgccgaggtgctgaaggatgtgcccgaagcgccgcgcgccgaccaggacgtgattcgccccatcagcaaccccatgtacgcccagggccacctggccatcctgaagggcaacctctcgcctgaaggctgcgtggccaaaatcaccggcctgaaaaacccggtcatgacgggcccggcccgcgtatttgacgacgagcagtcggcgctggccgccatcctggccggcaagatcaaggcgggcgacgtgatggtgctgcgttacctcggccccaagggcggtcccggcatgcctgaaatgctggcgcctaccggtgcgctgattggcgccggcctgggcgaaagcgtgggcctgatcaccgacggccgcttctccggcggcacctggggcatggtagtcggccatgtggcccccgaagcggccgccggcggcaatatcgcattcatcaacgaaggcgactccatcaccattgactcaaaacagttgctgctgcaactgaacatcagcgacgcggagctggaaaaacgcaaggtcggctggaaagcaccggcaccgcgctacaaccgcggcgtgcaggccaagtttgccttcaacgcgtcgagtgccagcaagggtgcggtgctggacgactattga

SEQ ID NO: 360 - protein, 564 aa, Polaromonas sp.
METKTIQLNPRSKNITEGKSRAPNRSMYYAMGYEEADFKKPMIGVANGHSTITPCNSGLQKLADAAIAGIEEAGGNAQVFGTPTISDGMAMGTEGMKYSLVSREVISDCIETCVQGQWMDGVLVIGGCDKNMPGGLMGMLRANVPAIYVYGGTILPGSYKGKDLNIVSVFEAVGENAAGRMSDEDLLQIERRAIPGTGSCGGMYTANTMSSAFEALGISLPYSSTMANPHDEKMNSARESAKVLVEAIKKDIKPRDLVTKKAIENAVAVIMATGGSTNAVLHFLAIAHAAGVDWTIDDFERVRQRTPVLCDLKPSGKYLAVDLHRAGGIPQVMKMLLAAGLLHGDCLTITGQTIAEVLKDVPEAPRADQDVIRPISNPMYAQGHLAILKGNLSPEGCVAKITGLKNPVMTGPARVFDDEQSALAAILAGKIKAGDVMVLRYLGPKGGPGMPEMLAPTGALIGAGLGESVGLITDGRFSGGTWGMVVGHVAPEAAAGGNIAFINEGDSITIDSKQLLLQLNISDAELEKRKVGWKAPAPRYNRGVQAKFAFNASSASKGAVLDDY

SEQ ID NO: 361 - DNA, 1695 bp, Polaromonas naphthalenivorans
atggaaaccaaagtcatcgccatcaaccgccgctcggccaacatcaccgagggcaagtcgcgcgcgcccaaccgctccatgtactacgccatgggctacgaggaaagcgatttcaagaaacccatgatcggcgtggccaacggccacagcaccatcacgccgtgcaacagcggcctgcaaaagctggcggacgcggcgattgacgcgattgaggaagccggcggcaatgcgcaggtgttcggcacgccgacgatttcggacggcatggccatgggcaccgaaggcatgaagtattcgctggtcagccgcgaagtcatttcggactgcatcgaaacctgcgtgcagggccagtggatggacggcgtgctggtggtcggcggctgcgacaagaacatgcccggcggcctgatgggcatgctgcgcgccaacgtgccggcgatttttgtctatggcggcacgatcttgccaggccattaccagggcaaagacctgaacatcgtcagcgtgttcgaagccgtcggtgaaaacgccgccggccgcatgagcgacgaagacctgctgcagattgagcgtcgcgccattcccggcaccggcagctgcggcggcatgtacaccgccaacaccatgtccagcgccttcgaggccctgggcatttcgctgccctactccagcaccatggccaatccgcatgacgaaaagctgaactcggcgaaggaatcggcccgggtgctgatcgaagcggtcaagaaagacatcaagccgcgcgacatcgtcaccaagaaatccattgaaaacgccgtggccgtcatcatggccaccggcggctcgaccaatgccgtgctgcatttcctggccatcgcccatgcggccggcgtcgaatggacgattgacgacttcgagcgcgtgcgccagaaaaccccggtgctgtgcaacctgaaaccctcgggccagtacctggcggtggacctgcaccaggccggcggcattccgcaggtcatgaaaatgctgctggtcgccggcctgctgcatggcgactgcatcaccatttcgggccagaccattgccgaagtgcttgcggacgtgcccgatgcgccgcgcgccggccaggacgtgatccgccccatcgaccagccgatgtatgcgcagggccacctggccatcctcaagggcaacctctcgcccgaaggctgcgtggccaagatcaccggcttgaagaacccggtcatgaccggcccggcccgggtgtttgaggacgagcagtccggcctgaaggcgattctggacggcaagatcgtggccggtgacgtgatggtgctgcgctacctcggccccaagggcggtcccggcatgcctgaaatgctggccccgaccggcgcgctgattggcgccggcctgggcgagagcgtcggcctgatcaccgacgggcgcttttccggcggcacctggggcatggtggtcggccatgtggcgccggaagcggcggccggcggcaatatcgccttcatcgaggaaggcgactcgatcacgattgacgccaatcagctgctgctgcaactgaacatcagcgacgccgagcttgaaagccgcaaggtcggctggacggccccggccccgcgttacacccgtggcgtgcaggccaagttcgccttcaatgcctccagcgccagcaagggcgcggtgcttgatgactattga

SEQ ID NO: 362 - protein, 564 aa, Polaromonas naphthalenivorans
METKVIAINRRSANITEGKSRAPNRSMYYAMGYEESDFKKPMIGVANGHSTITPCNSGLQKLADAAIDAIEEAGGNAQVFGTPTISDGMAMGTEGMKYSLVSREVISDCIETCVQGQWMDGVLVVGGCDKNMPGGLMGMLRANVPAIFVYGGTILPGHYQGKDLNIVSVFEAVGENAAGRMSDEDLLQIERRAIPGTGSCGGMYTANTMSSAFEALGISLPYSSTMANPHDEKLNSAKESARVLIEAVKKDIKPRDIVTKKSIENAVAVIMATGGSTNAVLHFLAIAHAAGVEWTIDDFERVRQKTPVLCNLKPSGQYLAVDLHQAGGIPQVMKMLLVAGLLHGDCITISGQTIAEVLADVPDAPRAGQDVIRPIDQPMYAQGHLAILKGNLSPEGCVAKITGLKNPVMTGPARVFEDEQSGLKAILDGKIVAGDVMVLRYLGPKGGPGMPEMLAPTGALIGAGLGESVGLITDGRFSGGTWGMVVGHVAPEAAAGGNIAFIEEGDSITIDANQLLLQLNISDAELESRKVGWTAPAPRYTRGVQAKFAFNASSASKGAVLDDY

SEQ ID NO: 363 - DNA, 1695 bp, Rhodoferax ferrireducens
atggacatcaaaccagtcatcctgaacccacgcagcaaaaacatcaccgagggcaaatcgcgggcgcccaatcgctccatgtactacgccatgggctacgaggccgacgacttcaagaagcccatgatcggtgtcgccaacggccacagcaccatcacaccgtgcaactccggcctgcaaaagctggccgatgccgccattgccgcgattgaagaagccggcggcaacgcccaggtgttcggcacccccaccatttccgacggcatgtcgatgggcaccgagggcatgaagtattcgctggtcagccgcgaagtaatttccgactgtattgagacctgcgtgcagggccagtggatggacggtgtgctggtgatcggcggttgcgacaaaaacatgcccggcggcctgatgggcatgctgcgcgccaatgtgcccgcgatttatgtctacggcggcaccattttgccgggccattacaagggccaggacctcaacatcgtgagcgtgttcgaggccgtgggcgagaacgccgcaggtcgcatgagcgacgaagatctgttggagattgagcgccgcgccatccctggccccggctcttgcggcggcatgtacaccgccaacaccatgagttcggcctttgaggcactgggcatctccctggtctactcgtccaccatggccaatccgcatgacgagaagctgaattcggcccaagaatcagccaaggtgctgattgaagccatcaagaacgacctgaagccgcgtgacatcgtgacccgcaaatcgattgagaacgcgattgccgttgtgatggcgattggcggctcgaccaacgcggtgctgcatttcctggcgattgcccatgccgcaggcgtggagtggacgattgacgactttgagcgtgtacgccaaaaaaccccggtgttgtgcgacctcaaaccgagcggcaagtacctggcggtggacctgcaccgcgccggtggcattccgcaagtgatgaagatgctgctaagcgctggcctgctgcacggcgactgcatcaccatcaccggccagaccgtggctgaagtgttgaaagacgtgccggatgcaccacgggcagaccaaaacgtgattcggccgatgaacaaaccgatgtatgcccagggccatctggccattctgaagggcaacctggccccggaaggctgcgtcgccaagatcaccggcctgaaaaacccggtcatgaccggcccggcacgcgtctttgaggacgaacaatcggccttggccgcgattctggccaacaagattgtggccggcgatgtcatggtgctgcgctacctcggccccaaaggcggccccggcatgcccgaaatgctggccccgaccggcgcgctggtcggccagggtttgggcgaatcagtcggcctgatcaccgacggccgtttctccggtggcacctggggcatggtggtcggtcacgtggcaccggaagcggctgccggcggcctgattgctttgattgaagaaggcgactcgatcaccatcgacgcgcaccagttgctgctgcaactcaacgtcagcgacgacatcattgccaaacgccgtagcgtgtggacggccccgcagccgcgctacacacgcggcgtgcaggccaagtttgcctttaacgcatccaccgccagcaagggtgcggtgctggacaactactga

SEQ ID NO: 364 - protein, 564 aa, Rhodoferax ferrireducens
MDIKPVILNPRSKNITEGKSRAPNRSMYYAMGYEADDFKKPMIGVANGHSTITPCNSGLQKLADAAIAAIEEAGGNAQVFGTPTISDGMSMGTEGMKYSLVSREVISDCIETCVQGQWMDGVLVIGGCDKNMPGGLMGMLRANVPAIYVYGGTILPGHYKGQDLNIVSVFEAVGENAAGRMSDEDLLEIERRAIPGPGSCGGMYTANTMSSAFEALGISLVYSSTMANPHDEKLNSAQESAKVLIEAIKNDLKPRDIVTRKSIENAIAVVMAIGGSTNAVLHFLAIAHAAGVEWTIDDFERVRQKTPVLCDLKPSGKYLAVDLHRAGGIPQVMKMLLSAGLLHGDCITITGQTVAEVLKDVPDAPRADQNVIRPMNKPMYAQGHLAILKGNLAPEGCVAKITGLKNPVMTGPARVFEDEQSALAAILANKIVAGDVMVLRYLGPKGGPGMPEMLAPTGALVGQGLGESVGLITDGRFSGGTWGMVVGHVAPEAAAGGLIALIEEGDSITIDAHQLLLQLNVSDDIIAKRRSVWTAPQPRYTRGVQAKFAFNASTASKGAVLDNY

SEQ ID NO: 365 - DNA, 1707 bp, Verminephrobacter eiseniae
atggcagacaacaagacgaccacgatcgagcctatcaaccgccgcagcgcgaacatcacacagggcaagtcgcgcgcacccaaccgctccatgtactacgccatgggctacgtggagggcgacttcgtcaagccgatggtcggcgtggccaatggccacagcaccatcacgccttgcaacagcgggctgcaaaaactgaccgatgccgccatcgagggcatcgaggaggccggcggcaatgcccaggtgttcggcacgccgaccatctcggacggcatggccatgggcaccgaaggcatgaagtacagcctggtcagccgtgaagtcatcagcgactgcatagaaacctgcgtcagcggccagtggctggacggcgtgctggtggtcggcggctgcgacaaaaacatgcccggcggcctgatgggcatgttgcgcgccaacgtgcccgcaatctatgtgtacggcggcaccatcctgcccggccactaccaggggcgggaactgaatatcgtcagcgtgttcgaggcggtgggcgaaaacgccgccggcaagctgagcgaccacgacctcagggagatcgaaaagcgcgccatccccggcaccggctcctgcggcggcatgtataccgccaacaccatgtccagcgcgttcgaggccctgggcatcagcctgccctactcgtcgaccatggccaacccgcatgacgagaagacgaactcggccaaggcatcggccaaggtgctgatcgaggccatccgcaacgacctcaagccgcgcgacatcgtgaccaggaaggccatcgagaatgcagtggccgtgatcatggccaccggcggctcgaccaacgccgtgctgcatttcctggcgatcgcccatgcggcaggcgtgccgtggagcatcgacgacttcgagcgcgtgcgccagaagacccccgtgctgtgcgacctcaagcccagcggcaaatacctggccgtggacctgcaccgcgcgggcggcatcccgcaggtgatgaagctgctgctcaacgccggcctgctgcatggcgactgcatcaccatcgagggcaagacgatggcccaagtgctcaaggatgtgcccgatcggccgcgcgcagaccagaacgtgatccgccccatcgaccagcccctgtacgcgcagggccacctggccatcctcaagggcaacctcagccccgaaggggccgtggccaagatcaccggcctgaagaacccggtcatcaccggcccggcgcgcgtgttcgacgacgagcaatctgcgctgcaggcgatactggacggcaagatccaggccggcgacgtgatggtgctgcgctacctggggcccaagggcggccccggcatgcctgaaatgctggcccccaccggcgcgctgatcggcgccggcctgggagaaagcgtgggcctgatcaccgacgggcgcttttccggcggcacctggggcatggtcgtcggccatgtggcgcccgaggccgccgcaggcggcaccatcgctttcgtgcatgaaggcgacagcatcaccatcgacgcccgccaactgctgctgcaattgaatgtggctgaggcagaaatcgcccggcgccgtgcccggtggacggcccccgctgcgcgctacacacgcggcgtgcaggccaagttcgccttcaacgcatcgagcgccagccaaggcgcggtgctcgacgcatactga

SEQ ID NO: 366 - protein, 568 aa, Verminephrobacter eiseniae
MADNKTTTIEPINRRSANITQGKSRAPNRSMYYAMGYVEGDFVKPMVGVANGHSTITPCNSGLQKLTDAAIEGIEEAGGNAQVFGTPTISDGMAMGTEGMKYSLVSREVISDCIETCVSGQWLDGVLVVGGCDKNMPGGLMGMLRANVPAIYVYGGTILPGHYQGRELNIVSVFEAVGENAAGKLSDHDLREIEKRAIPGTGSCGGMYTANTMSSAFEALGISLPYSSTMANPHDEKTNSAKASAKVLIEAIRNDLKPRDIVTRKAIENAVAVIMATGGSTNAVLHFLAIAHAAGVPWSIDDFERVRQKTPVLCDLKPSGKYLAVDLHRAGGIPQVMKLLLNAGLLHGDCITIEGKTMAQVLKDVPDRPRADQNVIRPIDQPLYAQGHLAILKGNLSPEGAVAKITGLKNPVITGPARVFDDEQSALQAILDGKIQAGDVMVLRYLGPKGGPGMPEMLAPTGALIGAGLGESVGLITDGRFSGGTWGMVVGHVAPEAAAGGTIAFVHEGDSITIDARQLLLQLNVAEAEIARRRARWTAPAARYTRGVQAKFAFNASSASQGAVLDAY

SEQ ID NO: 367 - DNA, 1695 bp, Acidovorax sp.
atgaccgacccgctgccgctgaaccgccgctccgcccacatcacccagggcaaggcgcgcgcgcccaaccgctccatgttctacggcatgggctaccaagagggtgacttcgccaagcccatggtgggcgtggccaacgggcacagcaccatcacgccctgcaacagcggcctgcaacgcctggccgacgcggccatcgcaggcatcgaggaagcgggcggcaacgcccaggtcttcggcacgcccaccatcagcgacggcatggccatgggtaccgagggcatgaagtacagcctggtgagccgcgaggtgattgccgactgcgtcgagacctgcgtgcagggccagtggatggacggcgtggtcgtcatcggcggctgcgacaagaacatgcccggcggcctgatgggcatgctgcgcgccaacgtgccggccatctacgtgtatggcggcaccatcctgccgggccgctggcaggggcaagacctgaacatcgtgagcgtgttcgaagccgtgggccagaacgccgcgggcaggatgaccgaccaggagctgaaggacatcgagcagcacgccatcccgggcacgggctcgtgcggcggcatgtacacggccaacaccatgtcctcggccttcgaggcgctgggcatgagcctgccctactcctccaccatggccaatccgcacgacgagaaaatgaactcggcccgcgaatccgcccgggtgctgatcgaggccatccgcaaggacttgaagccacgcgacatcgtcacgcgcaaggccatcgagaacgccgtggccgtgatcatggccacgggcggctccaccaacgcggtgctgcacttcctggcgatcgcgcacgcggcgggtgtggagtggtccatcgacgacttcgagcgcatgcgcaagaaggtcccagtgatctgcgacctcaagcccagcggccggtacctggccgtcgacctgcaccgcgcgggcggcattccccaggtgatgaaggtgctgctgaacgccggcctgttgcacggcgactgcatgaccatcaccggtaaaaccatcgccgaaaccctggccgacgtacccgacgcgccacggccggaccaggacgtgattcgcccgatcgacaaggcgctgtaccgcgaggggcacctcgccatcctcaagggcaacctgagtcccgagggcgccgtggccaagatcaccgggctgaagaaccccgtcatcaccgggcccgcgcgtgtgttcgacgacgagcagtcggcgctgcaggccatcctggacggcaggatcgtcgcgggcgacgtgatggtgttgcgctacctcggccccaagggtggcccgggcatgccggagatgctggcccccacgggcgcgctgatcggtgcgggcctgggcgagagcgtgggcctgatcaccgacgggcgcttctcgggcggcacctggggcatggtggtgggccacgtcgcgcccgaggccgctgcggggggcactattgcgctggtgcatgagggcgacacgatcaccatcgacgcccaccaactgctgctgcaactgcacgtggacgacgccacgctggcacagcgccgcgccgcctggcagccacccacgccgcgctacatgcggggcgtgcaggccaagtttgccttcaacgcctccagcgccagcaagggtgcggtgctggatgacttttcatga

SEQ ID NO: 368 - protein, 564 aa, Acidovorax sp.
MTDPLPLNRRSAHITQGKARAPNRSMFYGMGYQEGDFAKPMVGVANGHSTITPCNSGLQRLADAAIAGIEEAGGNAQVFGTPTISDGMAMGTEGMKYSLVSREVIADCVETCVQGQWMDGVVVIGGCDKNMPGGLMGMLRANVPAIYVYGGTILPGRWQGQDLNIVSVFEAVGQNAAGRMTDQELKDIEQHAIPGTGSCGGMYTANTMSSAFEALGMSLPYSSTMANPHDEKMNSARESARVLIEAIRKDLKPRDIVTRKAIENAVAVIMATGGSTNAVLHFLAIAHAAGVEWSIDDFERMRKKVPVICDLKPSGRYLAVDLHRAGGIPQVMKVLLNAGLLHGDCMTITGKTIAETLADVPDAPRPDQDVIRPIDKALYREGHLAILKGNLSPEGAVAKITGLKNPVITGPARVFDDEQSALQAILDGRIVAGDVMVLRYLGPKGGPGMPEMLAPTGALIGAGLGESVGLITDGRFSGGTWGMVVGHVAPEAAAGGTIALVHEGDTITIDAHQLLLQLHVDDATLAQRRAAWQPPTPRYMRGVQAKFAFNASSASKGAVLDDFS

SEQ ID NO: 369 - DNA, 1695 bp, Delftia acidovorans
atgaccccgccgaaccagatcaaccgccgaagctcccacatcaccgaaggcaaggcgcgcgcagccaaccgctccatgttctacggcatgggctacaaggaagaggatttcaagaagcccatggtcggcgtggccaacggccacagcacgatcacgccgtgcaactccggcctgcaaaggctggcggacgcggccatcgcaggcatcgaggaagccggcggcaacgcgcaggtgttcggcacgccgaccatctcggacggcatgtccatgggcacggaaggcatgaagtactcgctggtcagccgcgaggtgatcgccgactgcatagagacctgcgtgggcggccagtggatggacggcgtgctagtggtcggcggctgcgacaagaacatgccgggcggcatgatgggcatgctgcgcgccaatgtgccggccatctacgtctacggcggcaccatcctgcccggcaggtggaaaggccgggacctgaacatcgtcagcgtgttcgaggccgtcggcgaaaacgccgcgggaaagatcagcgaccaggagctcaaggacatcgagcagcacgccattcccggcacgggctcgtgcggcggcatgtacaccgccaacaccatgtcgagcgcgttcgaggcgctgggcatgagcctgccctactcctccaccatggccaatccccatgatgaaaaggaaaactcggccaaggaatccgccagggtgctgatcgaggccatcaagatggacctcaagccgcgcgatatcgtgacgcgcaagtccatcgagaacgcggtctcggtgatcatggcgaccgggggctccaccaatgccgtgctgcactttcttgcgatcgcccatgcggccggcgtgccctggtccatcgacgacttcgagcgcatccgccagcgggtgccggtgctgtgcgatctcaagcccagcggcagatacctggcggtggacctgcaccaggcgggcggcatcccgcaggtcatgaagatcctgctgaatgcgggcctgctgcacggcgactgcatcaccatctcgggccagaccattgcgcagaccctggctggcgtgcctgacgaaccaccgaacccgcagatcatccgccccctctcggatgcactctatccgcagggccacctggccattctcaagggcaacctgagcccggaaggcgcggtggccaagatcacgggcctgaagaacccggtcatcaccggcccggcacgcgtgttcgacgatgagcaatcggcactggcggccatcctcgacggcaggatacaggccggcgatgtgatggtgctgcgctacctgggccccaagggcggccccggcatgccggaaatgctggcccccacgggcgccctgatcggcgccggcctgggcgagagcgtgggcctgatcaccgatggccgcttctccggcggcacctggggcatggtggtcggccacgtggcgccggaagcggccgtgggcggcaccatcgcgctggtgcacgagggcgactcgatcaccatcgacgcgcacgcattgcggctgcagctgaacgtgcccgaagacgtgctcgcccagcgccgcgcggcatggaaggcccccgcgccccgctacacgcggggcgtgcaggccaagttcgctttcaacgcatcgagcgccagctcgggcgcggtgctggacaacttcgccatctga

SEQ ID NO: 370 - protein, 564 aa, Delftia acidovorans
MTPPNQINRRSSHITEGKARAANRSMFYGMGYKEEDFKKPMVGVANGHSTITPCNSGLQRLADAAIAGIEEAGGNAQVFGTPTISDGMSMGTEGMKYSLVSREVIADCIETCVGGQWMDGVLVVGGCDKNMPGGMMGMLRANVPAIYVYGGTILPGRWKGRDLNIVSVFEAVGENAAGKISDQELKDIEQHAIPGTGSCGGMYTANTMSSAFEALGMSLPYSSTMANPHDEKENSAKESARVLIEAIKMDLKPRDIVTRKSIENAVSVIMATGGSTNAVLHFLAIAHAAGVPWSIDDFERIRQRVPVLCDLKPSGRYLAVDLHQAGGIPQVMKILLNAGLLHGDCITISGQTIAQTLAGVPDEPPNPQIIRPLSDALYPQGHLAILKGNLSPEGAVAKITGLKNPVITGPARVFDDEQSALAAILDGRIQAGDVMVLRYLGPKGGPGMPEMLAPTGALIGAGLGESVGLITDGRFSGGTWGMVVGHVAPEAAVGGTIALVHEGDSITIDAHALRLQLNVPEDVLAQRRAAWKAPAPRYTRGVQAKFAFNASSASSGAVLDNFAI

SEQ ID NO: 371 - DNA, 1683 bp, Methylibium petroleiphilum
atgagcatcaaccgccgttcgaagaacatcaccgaaggcgtggcccgcgcacccaaccgctcgatgtactacgcgatgggctaccaggaggccgacttcaagaagccgatgatcggcgtggcgaacggccactcgaccatcacgccctgcaactcgggcctgcagaagctggccgacgccgcggtcgagggcatcgaggcggccggcggcaatgcacagatcttcggcacccccaccatcagcgacggcatggcgatgggcaccgagggcatgaagtactcgctggtctcgcgcgaggtcatcgccgactgcgtggaaacctgcgtcggcggccagtggatggacggcgtgctggtggtcggcggctgcgacaagaacatgccgggcggcatgatgggcatgctgcgcgccaacgtgcccgcgatctacgtctacggcggcaccatcctgccgggaaagtacaagggccaggatctcaacatcgtcagcgtgttcgaggccgtcggccagttcaccgcgggcaacatgagcgaggaagacttctgccagatcgagcgacgcgcgatcccgggcagtggctcctgcgggggcatgtacaccgccaacaccatgagttcggccttcgaggccctgggcatgagcctgccgttcgcctccacgatggccaatgtcgaggacccgatcgtcgcgcacaccaaggaagcggcgcgcgtgctggtcgaggcagtgaaggccgacctcaagccgcgtgacatcgtcacacgcaagagcatcgagaacgcggtcgcggtgatcatggccaccggcggctcgaccaatgcggtgctgcacttcctggccatcgcgcacgccgccggcgtcgagtggacgatcgacgacttcgagcgcgtgcgccgcaaggtgccggtgctgtgcgacctcaaacccagcggcaggtacctggcgatcgacctgcaccgcgccggcggcatcccgcaggtgatgaagacgctgctcgccgccgggctgatccacggcgactgcatcaccatcaccggaaggaccgtggccgagaacctggccgacatccccgatgcgccgcgcgccgaccaggacgtgatccgcccgatcacgaagccgatgtacgagcaaggccacctggccatcctgaagggcaacctgtcgcctgagggcgccgtggccaagatcaccggcctgaagaatcccagcatcactggcccggcgcgcgtgttcgacgacgagcagtcggcgctggccgccatcatggccaagcagatccaggccggcgacgtgatggtgctgcgctacctgggcccgatggggggcccgggcatgcccgagatgctggcgccgaccggtgcgctgatcggccaagggctgggcgaatcggtggggctcatcaccgacggccgcttctccggcggcacctggggcatggtggtcggccacgtggcacctgaggccgcggccggcggcacgatcgcgctggtgcaggaaggcgactcgatcaccatcgatgcgcacacgctggtgctcaacctcaacgtgagcgaggccgagatcgcaaagcgtcgcgccgcctggaaggcaccggcgccgcgctacacacgcggcgtgctggccaagttcgcgaagaacgcgtcaagcgccagcagcggcgcggtattggaccgcttcgagtag

SEQ ID NO: 372 - protein, 560 aa, Methylibium petroleiphilum
MSINRRSKNITEGVARAPNRSMYYAMGYQEADFKKPMIGVANGHSTITPCNSGLQKLADAAVEGIEAAGGNAQIFGTPTISDGMAMGTEGMKYSLVSREVIADCVETCVGGQWMDGVLVVGGCDKNMPGGMMGMLRANVPAIYVYGGTILPGKYKGQDLNIVSVFEAVGQFTAGNMSEEDFCQIERRAIPGSGSCGGMYTANTMSSAFEALGMSLPFASTMANVEDPIVAHTKEAARVLVEAVKADLKPRDIVTRKSIENAVAVIMATGGSTNAVLHFLAIAHAAGVEWTIDDFERVRRKVPVLCDLKPSGRYLAIDLHRAGGIPQVMKTLLAAGLIHGDCITITGRTVAENLADIPDAPRADQDVIRPITKPMYEQGHLAILKGNLSPEGAVAKITGLKNPSITGPARVFDDEQSALAAIMAKQIQAGDVMVLRYLGPMGGPGMPEMLAPTGALIGQGLGESVGLITDGRFSGGTWGMVVGHVAPEAAAGGTIALVQEGDSITIDAHTLVLNLNVSEAEIAKRRAAWKAPAPRYTRGVLAKFAKNASSASSGAVLDRFE

SEQ ID NO: 373 - DNA, 1683 bp, unknown
  gamma proteobacterium KT 71
atggcgctcaatcgtcgctccaaaaacatcaccgagggcgtccaacgtgcgcccaatcgctccatgtactacggcatgggctatgaggagggcgattttaggaagcccatggtgggcattgccaactctcactcgacgatcacgccctgtaatgcgggactccagcccctggctgatgccgctcaggaaggcctgaaagaagccggggccaatcctcaggtgtttggcacgccgaccatatccgacggcatgtccatgggtaccgagggcatgaagtactccctggtatcccgggaagttatcgctgactgcatcgaaacctgcgtgggcggtcagtggatggacggcgtgctggtgatcggtggctgtgacaaaaacatgcccggcggcatgatgggcatgctccgcgcaaacgtcccctcgatttttgtatacggcgggaccattcttcccgggcgtcacaatggtcaggatctgaacatcgtcagcgtgtttgaggcggtcggtgagcatgcggcggggcgtatcagggacgaggatttactggctatcgaacgcaatgcgattccgggaacgggctcctgcggcggtatgtataccgcaaacaccatgagctcggcctttgaggccctgggcatgagccttccttattcctcgaccatggcaaacgtcgagtccgaaatcaaagaatcagccaaggcgagcgcgctggctctggtggaggcgattcgcctggatcttaagcccagggatattgtgacccgcgagtccctggaaaatgccgttgcggtgattatggcgaccgggggatcgaccaatgcggtattacactttctggcgattgcccacgccgcggagattgactggagtatcgacgactttgagcgaatccgacaaaaagtaccggtgctctgcgatctcaagcccagcggggagtatctggccattgatctgcaccgtgctggcggcattccccaggtgatgaaaattctcttggacgggggcttgctccacggcgactgcatgaccgtaacgggcaagactattgcggaatccctggcggatgtgccttcgacgcccgtggaccccaaggtcattcgtcctctggataaccccatgtatgccaaggggcatctggcgattcttcgcggcaatctcgccgaagagggcgccgtagccaaaatcacgggtctgaaaaaccccgtgatcacgggacctgcgaaagtgtttgatgatgaacagtcggcccttgatgccattctcgcgggcaaggtcaaagccggtgacgtggtggtactgcggtatctagggccccagggcggaccgggtatgcccgagatgctggcacccaccagtgctctggtggggcagggtctcggggagtccgtaggcctgattaccgacggccgattttccgggggcacctgggggatggttgtggggcatgtggcacccgaagcctatgcgggtggtctcattgccctgatagaggagggggactccatcaccatcgatgcccataccctgagtctggaactcaatgtcgacgacaaagaaattgctcgccggcgcggcgcctgggtaaagcccgagccacgctacacccggggcgtcctcgccaagtttgcaaaaaatgcagccaccgcaagccgcggcgcggtgctggatctgtatgaggactaa

SEQ ID NO: 374 - protein, 560 aa, unknown
  gamma proteobacterium KT 71
MALNRRSKNITEGVQRAPNRSMYYGMGYEEGDFRKPMVGIANSHSTITPCNAGLQPLADAAQEGLKEAGANPQVFGTPTISDGMSMGTEGMKYSLVSREVIADCIETCVGGQWMDGVLVIGGCDKNMPGGMMGMLRANVPSIFVYGGTILPGRHNGQDLNIVSVFEAVGEHAAGRIRDEDLLAIERNAIPGTGSCGGMYTANTMSSAFEALGMSLPYSSTMANVESEIKESAKASALALVEAIRLDLKPRDIVTRESLENAVAVIMATGGSTNAVLHFLAIAHAAEIDWSIDDFERIRQKVPVLCDLKPSGEYLAIDLHRAGGIPQVMKILLDGGLLHGDCMTVTGKTIAESLADVPSTPVDPKVIRPLDNPMYAKGHLAILRGNLAEEGAVAKITGLKNPVITGPAKVFDDEQSALDAILAGKVKAGDVVVLRYLGPQGGPGMPEMLAPTSALVGQGLGESVGLITDGRFSGGTWGMVVGHVAPEAYAGGLIALIEEGDSITIDAHTLSLELNVDDKEIARRRGAWVKPEPRYTRGVLAKFAKNAATASRGAVLDLYED

SEQ ID NO: 375 - DNA, 1665 bp, Tremblaya princeps
atgaacacgaactcaagacgcataacgcatggattcaccaggtctccgaacagggccatgctctgtgccatggggtacgatggcgcagactttgccaagcccatcataggcgtaggaagcggttactccaccataacaccgtgcaatgctggcatacagcgcgtcgtcgatgcggcgaaagccatgctggcaaggcatggagccatgacgcaggttttcggcatccctaccatatccgacggcatatcaatgggcacgccgggcatgaggtactctctcgtgtctcgtgaggtgatcgctgattgtatagaggcatgtgcttgtgggcagagcatggacgggctgctagtcgtagggggctgcgataagaacctgcctggtggcatgatcgggctactacgagccaacatcccagggatttacctgtatggcggcacaatactgccagggtactggggcgccagggagctgactgtggtgagttcattcgaggcagttggcgccatgggtaggcagggcatgtctatagacgctatgcgtgaagtggagcgacacgcctgccccactacaggctcgtgcggcgggatgtacacagcaaacacaatgagcgcatcatttgaggcccttggcatgtccctgctctactcgtccactgctccgagcccaggcatcgagggtgagctatccatctcaacgtcggcacggtctctgatcaacgcagtgcgacggggcataaggccaagggacgtggtaactcacaggtccattcgcaatgccatggcggttgtaatggcagtcggcgggtctacaaacgccgtgctgcactacctggcgatagccgctgcagctcgttctgctctctcactgcacgacgttgagctaataaggaggagggtgcctgtaatatgtaacatgaagccctctggactgcatagcactgcagacctacattcagcaggcggcgttcctcgtgttatgcacgagcttgcgctcgctggtctcattgacgagtcgtgcctcacgataacgggcagaacgataggtgcagagctcctcgcggcgcaccgcaagcgccatggctctaccgttgtgctgcctactaacatggcgttataccgtacaggacgccttgttgtgctgagcggtaatatgtcaaggaacggcgcagttgccaagacttcaggccttagcatactattgcacagcggcactgccagagtgtttcgcagcgaggaggcctgtgttcaggctatactcaacggctgcgtgcgcattggcgacgtagttgtgctgatttacctaggcccaaagggagggcctggcatgcctgagatgctatccccaactgcagcgctagttggcatgggactaggccagtccgcttgcctcattacagatggtaggttctctggaggaacgtggggcctggtggtcgggcatgtatcacccgaggcagccgtgggtggctccatagcgcttgtccgtaacggcgacttcatcacagtagacctgcgcaacaactctcttcacctgcatatagacgcatggtcgcttgctgcacggcgtgcagcatggcggctaccttgcactttgtgtgtagagggactactgagaaagtaccacgatggagttggccagtctcacaatggcgccatcgctgcatag

SEQ ID NO: 376 - protein, 554 aa, Tremblaya princeps
MNTNSRRITHGFTRSPNRAMLCAMGYDGADFAKPIIGVGSGYSTITPCNAGIQRVVDAAKAMLARHGAMTQVFGIPTISDGISMGTPGMRYSLVSREVIADCIEACACGQSMDGLLVVGGCDKNLPGGMIGLLRANIPGIYLYGGTILPGYWGARELTVVSSFEAVGAMGRQGMSIDAMREVERHACPTTGSCGGMYTANTMSASFEALGMSLLYSSTAPSPGIEGELSISTSARSLINAVRRGIRPRDVVTHRSIRNAMAVVMAVGGSTNAVLHYLAIAAAARSALSLHDVELIRRRVPVICNMKPSGLHSTADLHSAGGVPRVMHELALAGLIDESCLTITGRTIGAELLAAHRKRHGSTVVLPTNMALYRTGRLVVLSGNMSRNGAVAKTSGLSILLHSGTARVFRSEEACVQAILNGCVRIGDVVVLIYLGPKGGPGMPEMLSPTAALVGMGLGQSACLITDGRFSGGTWGLVVGHVSPEAAVGGSIALVRNGDFITVDLRNNSLHLHIDAWSLAARRAAWRLPCTLCVEGLLRKYHDGVGQSHNGAIAA

SEQ ID NO: 377 - DNA, 1689 bp, Blastopirellula marina
atgtctcagcccctcaattggaatagtcgccgtttaacgcgtggatggcaaaaagggatcaccgctttttattacggcttgggactgaccgacgccgattttgacaaaccgcagatcgggatcggcgtgccgctgctggacggcaatctttgcaacgtccacgcctatcaactgggccaagagctgaaagcaggctgcgagcaagcgggactgatcgggtttccgtttggcacgccggccgttagcgataacatcacgcaaggacatgaagggggcaacgccagccttccctcgcgtaatatgatcgccaatgcggctgaatgcgtcgtcagcgcccatggctacgactttttgatcggactgcacaattgcgacaaaaacgggcccggcttcgccatggcgttggctcggctcaactatcccgggctgatcgtcaacggcggcagtattaaacctggttgccatctgggccgcgacacgtcgatcttggatgtctacgacgcccaagcggcggcttccgtgggcgcaatgacggcggacgaagcggatcagatcttgcgaaccgcttgtcccggacccggcgggtgcggcatcgccgcttcttttaatacttggggaatcgcgatcgaagcgatcgggctagggcttccctactccagttcgatcccggctgaagatccggccaaacgcgaagaatgccgcagcatcggccaagcagtcaagcatctgctgaccgagaacattcgcccccgcgatattttgaccaaaaaggcgtttgaaaacgcagccgcggtgatcgccgccgtgggcggctcgaccaacggcgtgctgcacctgatcgcgctggccaaagaagccgaagttgatttcacattgcgtgacgtgcagcggattgtccgcaacacgccggtcctgtgcagcttcgctccgcgcggcaaacgcacgatgtacgacctgcacaagctggggggtacgccgatgctgctgaagtacttgatctcggtcggcattgtcgatggttcgtgcctgaccgtctcgggcaagtcattggccgaaaacgtcaacggcgcggccgatgttcccgcggatcaagacttgatcgcgacgatcgaaaagccgttcaaagaatatgccgacatgcagatctgctttggcaacctggcgcccggcggcgtggtcttcaaagtatcgagcatgcgtgacccaaaattcagcggcaaagcgatctgcttttcggaagccaaggatatcgtcaacgcggtcgaagcgaataagatcacgccgggaaccgtgatcgtgcttcgttatctggggccggtcgcttcggggatgccggaagtgttggtcgcgaccgcggctttggccgtaccgcatctggacggcaaagtagcgtttctgtcagacacgcgcgtctctggcgtatcgcacggagcgatcggcgttcactgtgctccggaagcggcagtcggcgggccgatcgcgttggtggaagacggggatgaaatctcgtttgatctgctcggcggcgagatcacgctgcacgtcggagcagacgtgttggcgactcgcgccgccaactggaagacgcctgacctgcggcacaaacatgcctatctggccgacttcgccgcaaccgtctcgcaagccgatagcggttgcgtcagcaaagcgtttcacgacgtctcgtaa

SEQ ID NO: 378 - protein, 562 aa, Blastopirellula marina
MSQPLNWNSRRLTRGWQKGITAFYYGLGLTDADFDKPQIGIGVPLLDGNLCNVHAYQLGQELKAGCEQAGLIGFPFGTPAVSDNITQGHEGGNASLPSRNMIANAAECVVSAHGYDFLIGLHNCDKNGPGFAMALARLNYPGLIVNGGSIKPGCHLGRDTSILDVYDAQAAASVGAMTADEADQILRTACPGPGGCGIAASFNTWGIAIEAIGLGLPYSSSIPAEDPAKREECRSIGQAVKHLLTENIRPRDILTKKAFENAAAVIAAVGGSTNGVLHLIALAKEAEVDFTLRDVQRIVRNTPVLCSFAPRGKRTMYDLHKLGGTPMLLKYLISVGIVDGSCLTVSGKSLAENVNGAADVPADQDLIATIEKPFKEYADMQICFGNLAPGGVVFKVSSMRDPKFSGKAICFSEAKDIVNAVEANKITPGTVIVLRYLGPVASGMPEVLVATAALAVPHLDGKVAFLSDTRVSGVSHGAIGVHCAPEAAVGGPIALVEDGDEISFDLLGGEITLHVGADVLATRAANWKTPDLRHKHAYLADFAATVSQADSGCVSKAFHDVS

SEQ ID NO: 379 - DNA, 1692 bp, Planctomyces maris
atggatcatcctttaaactggaatagtcaaaacctgacacatggctggcaacggggagtcaccgctttttattacgggttaggcttttcggatcaggatttcgacaaggcccagatcgggattggcgtgccactcttggatggcaacctctgtaatgtgcatgcttacgatcttgcgaaagtaattgcacagggatgtcaatccgctgacatgatcggtcttccttttggagttcccgccgtcagtgacaacatcacccagggacaggaaggaggcaacgccagtctcccctctcggaatatgatcgccaacgcggccgaatgcgtcgtgagtgctcattcgtatgatgccctgattggcctgcataattgcgataaaaacggaccgggcttcgccatggcattggcacgactcaactatccgggactggtcgtcagtggtggcagtatcatgcccggctgccacaaaggacaggacatttcgatcctcgacgtctacgattcccaggcagctgcagcagtcggcgcgatggaagaagaagaagcggaccagattctgaaaaccgcctgcccgggcccggggggatgtggtatcgccgcttctttcaatacctggggcatcgcgctcgaagccatcggccttatgctcccgttcagcagttccacgccggccattgataatgcaaaaaaaacagaatgcctcaatgtcgcctctgccgtgcgaaatctcctgcagaaaaatatccggccgcgcgacatcctgacccgcaaagcatttgaaaatgcagccgccaccatcgcggccgtcggcggctccacgaatggaatcctgcatctgctcgcgctggcacgagaagcggaagtcgaattttacctgcaggacattcaggaaattcttcgaaaaacgcccgtgtattgcagttttgcaccacgcggcaaaaaaaccatggtcgacctgcatcacctgggtggcacaccggtcctcatgaaacacctgctcaaagcaggcatcatcgatggcagttgcctgactgtaaccggcagaaccctggcggaaaacctggcagaaatcggcgatgtccccacgaaccaggaactgatcgcttcgctcgatcaaccgtataaaacttacgccgacatgcagatctgctttggcaatctggcaccgggaggcattgtctttaaagtttccagcatgcaggaatcacatttcacgggaaccgcctgctgcttcgatgaagcgaaaggcgtagtcgatgccgtcgaagcaggtaagatcaaacccggcagtgtcatcgtactacgaaacctgggtccggtcgcatcaggcatgcctgaagtacttgtcgcgactgccgctctgacggtaccggaactggatggcaaagtggcattcatttcggacacacgtgtctccggtgtttcacacggtgccatcggcgtgcattgttctcccgaagcggcagtcggaggtccgattggtctgattcaggatggtgaccagatctcgttcgatctgcttaaaggagaaatcagcgttgatgtctccgaccaggaatttcagcaacgccgagtgaaaaaaccacttcaacccgtcagacattcccgcggctatctggctgatttttcagccaccacctcacaggcacatcatggctgtgtgagtaaagccctgctgccggactgcgaataa

SEQ ID NO: 380 - protein, 563 aa, Planctomyces maris
MDHPLNWNSQNLTHGWQRGVTAFYYGLGFSDQDFDKAQIGIGVPLLDGNLCNVHAYDLAKVIAQGCQSADMIGLPFGVPAVSDNITQGQEGGNASLPSRNMIANAAECVVSAHSYDALIGLHNCDKNGPGFAMALARLNYPGLVVSGGSIMPGCHKGQDISILDVYDSQAAAAVGAMEEEEADQILKTACPGPGGCGIAASFNTWGIALEAIGLMLPFSSSTPAIDNAKKTECLNVASAVRNLLQKNIRPRDILTRKAFENAAATIAAVGGSTNGILHLLALAREAEVEFYLQDIQEILRKTPVYCSFAPRGKKTMVDLHHLGGTPVLMKHLLKAGIIDGSCLTVTGRTLAENLAEIGDVPTNQELIASLDQPYKTYADMQICFGNLAPGGIVFKVSSMQESHFTGTACCFDEAKGVVDAVEAGKIKPGSVIVLRNLGPVASGMPEVLVATAALTVPELDGKVAFISDTRVSGVSHGAIGVHCSPEAAVGGPIGLIQDGDQISFDLLKGEISVDVSDQEFQQRRVKKPLQPVRHSRGYLADFSATTSQAHHGCVSKALLPDCE

SEQ ID NO: 381 - DNA, 1839 bp, Salinibacter ruber
gtgaggctgccgtctttcacgcttcacgtttcacgcatcacgaaaacagcaccttctttcccttccacttttcccttttgcccaatgcccccctcctccgccaacggccactcctccaaaatccagagccaagacgtcaccgagggccttgaccaggcgccggcccgcgcgatgtttcgggcgatgggctacgacgacgccgacctcgaccagcccctcatcggcatcgccaacccggcggcggacgtgacgccctgcaatgtgcacctcgacggccttgccgacgccgcacgcgaaggcgtcactgaggccggcgggacgcccatcgagtttggcaccatcacggttagcgacgggatctcgatgggcacggagggcatgaaggggtccctcatctcccgcgaggtgatcgccgactcggtggaactggtggcctttgccgagcggctcgacgggctcgtcatcatgggcggctgcgacaaaaacatgccgggcatgatgatggcggcgatccgggccgacctcccgagcgtcttcctctacggcgggtccatcatgccgggccaccaccgggggcaggagatcacgatccagaacgtgttcgaggcgtgcggggcggtcgccaccggccagatgagcgaagaggagctcgacgagatggagcgccacgcctgtcccggcgccggcgcctgcggcggcatgttcaccgctaacacaatggcgtccatcagcgaggcgatcggctttgcgccgctggggagcgcgagccccccggcggtgacagaagaacgagaggtggtggcccgcgcggccgggcggcggaccgtcgaggcgatcgaggaacggcggcggccctccgacttcctcagcaagaagtcgttcgagaacgccattgccctccaggtggccgtgggcggctccacgaacggcgtactccacctgctcgcgatggcggcggaggcgggcatcgacctctcgattgaggcgttcgacgcaatcagccggcggacgcccaagatcggcgacttccagcccggcggctcccgcgtgatgaacgacctgcacgaggtcggcggcgtgccggtggtgctgaaggcgcttctcgatgcgggcctgctgcacggcgacgcccagaccgtgacgggggagcccctcgccgaggccctcgaccgcgtcgacccgcccgccatcgcggacctcgacgtggactacctctacacggtggacgaaccgaagaatgaggagggcgccatccgcatcctcaccggcaacctcgcccccgacggcgctgtgctcaaagttacagccgctgatgccccccgctttgagggcacggcccgcgtcttcgagagcgaggaggacgcaatggactacgtgcaggccggccagctcgactcgggcgacgtcattatcattcggaatctcgggcccaagggcgcccccggcatgcccgaaatgcttggcgtgaccgccgcccgggacggacaggggcacgccgacgacgtggccctcatcaccgacgggcgcttctccggggccacccgcggcctctccatcggccacgtcgcccccgaggccgcggccggcgggcccatcgccgccatccaggacggagacccgatcatcatcgacgtggcggagcgtcacctggcggtcgacctgtccgacgccgagctggagcgccgactcgacgaccggtcgcccccggagccccagtacacgaccggcgttctcgccaagtacgccgccctcttcggctccgccgcggagggggcagtgacgagtgtcttttcggatcttcgcgagtcgacatccccctccacggcttcaaatgaatga

SEQ ID NO: 382 - protein, 612 aa, Salinibacter ruber
MRLPSFTLHVSRITKTAPSFPSTFPFCPMPPSSANGHSSKIQSQDVTEGLDQAPARAMFRAMGYDDADLDQPLIGIANPAADVTPCNVHLDGLADAAREGVTEAGGTPIEFGTITVSDGISMGTEGMKGSLISREVIADSVELVAFAERLDGLVIMGGCDKNMPGMMMAAIRADLPSVFLYGGSIMPGHHRGQEITIQNVFEACGAVATGQMSEEELDEMERHACPGAGACGGMFTANTMASISEAIGFAPLGSASPPAVTEEREVVARAAGRRTVEAIEERRRPSDFLSKKSFENAIALQVAVGGSTNGVLHLLAMAAEAGIDLSIEAFDAISRRTPKIGDFQPGGSRVMNDLHEVGGVPVVLKALLDAGLLHGDAQTVTGEPLAEALDRVDPPAIADLDVDYLYTVDEPKNEEGAIRILTGNLAPDGAVLKVTAADAPRFEGTARVFESEEDAMDYVQAGQLDSGDVIIIRNLGPKGAPGMPEMLGVTAARDGQGHADDVALITDGRFSGATRGLSIGHVAPEAAAGGPIAAIQDGDPIIIDVAERHLAVDLSDAELERRLDDRSPPEPQYTTGVLAKYAALFGSAAEGAVTSVFSDLRESTSPSTASNE

SEQ ID NO: 383 - DNA, 1686 bp, Microcystis aeruginosa
atggcagataactacagaagtcgcattgttacccaaggtacccaacgcagtcctaatcgggccatgttaagagcggtaggttttggggatgaggactttagcaaaccaatcatcggcattgctaacggatttagcaccattaccccctgtaacatgggaattaatgatttagcaatgcgtgccgaagcagccaccagattagcggggggaatgccgcaacttttcgggactatcaccattagtgacgggatttccatgggaacagaaggaatgaaatattctctcgtttctagggaagtaatcgccgattccattgaaaccgtctgtaatggtcaaagtctcgatggagtcctcgctatcgggggttgtgacaaaaatatgccgggagcaatgattgccatggcccggatgaatattcccgctattttcgtctatggtggcacaattaaaccgggacgctacaaagattgcgatttaaccgtggtcagttcctttgaagccgtgggacagtacagcgccggtaaaatcagcgaagaagacctcatcgggattgaacgcaacgcttgccccggtgctggttcctgtggtggaatgtttactgctaataccatgtcttccatttttgaagccatggggatgagtttaccctattcctcaaccatggccgccgaagatgaggaaaaagccgatagtaccgaagaatcggccaaggttttagtcgaggcggttagaaaacagattctacctagccaaattttgacccgtaaagcctttgaaaacgccatttcggtaattatggcggtgggaggttccactaacgctgtcctgcaccttttagccatttcccgcaccatcggggtagaattatcgatcgatgattttgaaaccatccgccagcgtgtaccagttatctgcgatcttaaaccctccgggcgttacgttaccgtagatctgcataaagccggcggtattccccaagtgatgaaaattctcctggttaatggtttactacacggggatgctctcaccattagcggtcagactatcgccgagattttagccgatattcccgaccaaccgccctcaggccaagatgttatccgtccttttagcaatcctgtctataaagagggtcatttagccattttaaaaggaaatctggccacggaggggtctgtggccaaaatcagcggcgtgaaaactccggtcatcactgggcccgcgcgggtgtttgagtcggaagaaacctgtttagaggcaattttagccggaaaaattcaagccggggatgtggtggttgtccgttacgagggaccagtaggcggaccgggtatgcgggaaatgttagcccccacttcggcaattatcggcgctggtttaggggattccgtgggattaattaccgatggtcgtttttccgggggaacctatggcatggtagttggtcacgtcgctccagaagcggcggtgggtggtacaattgccctagtagaggaaggggatcaaatcactattgatgctcgtcaacgtctcttgagtttaaatgtatcggaggaagaattaacccgtcgtcgtcaccattggcaaccgcgtcccccacgctataaaacgggaattctcggcaaattcgccaagttagtctcctctagcagtctcggcgctttaacggatttgaatctgttctaa

SEQ ID NO: 384 - protein, 561 aa, Microcystis aeruginosa
MADNYRSRIVTQGTQRSPNRAMLRAVGFGDEDFSKPIIGIANGFSTITPCNMGINDLAMRAEAATRLAGGMPQLFGTITISDGISMGTEGMKYSLVSREVIADSIETVCNGQSLDGVLAIGGCDKNMPGAMIAMARMNIPAIFVYGGTIKPGRYKDCDLTVVSSFEAVGQYSAGKISEEDLIGIERNACPGAGSCGGMFTANTMSSIFEAMGMSLPYSSTMAAEDEEKADSTEESAKVLVEAVRKQILPSQILTRKAFENAISVIMAVGGSTNAVLHLLAISRTIGVELSIDDFETIRQRVPVICDLKPSGRYVTVDLHKAGGIPQVMKILLVNGLLHGDALTISGQTIAEILADIPDQPPSGQDVIRPFSNPVYKEGHLAILKGNLATEGSVAKISGVKTPVITGPARVFESEETCLEAILAGKIQAGDVVVVRYEGPVGGPGMREMLAPTSAIIGAGLGDSVGLITDGRFSGGTYGMVVGHVAPEAAVGGTIALVEEGDQITIDARQRLLSLNVSEEELTRRRHHWQPRPPRYKTGILGKFAKLVSSSSLGALTDLNLF

SEQ ID NO: 385 - DNA, 1731 bp, Methylobacterium chloromethanicum
atggacgcgcgtcagaccgacaagtcgaagctgccgagccggcacgtgacggaggggcccgagcgggcgccccaccgctcgtacctctacgccatgggcctgacgaccgagcagatccaccagccgctggtcggcgtcgcctcgtgctggaacgaggccgcgccctgcaacatctcgctgatgcgccaggcccaggccgtgaagaagggcgttgccgccgccaagggcaccccgcgcgagttctgcaccatcaccgtcaccgacggcatcgccatgggccatggcggcatgcgtgcctcgctgccgtcgcgcgaggtcatcgccgattcggtcgagctgacgatccgcggccattcctacgacgccctcgtggggctggccggctgcgacaagtccctgcccggcatgatgatggccatggtgcgcctcaacgtgccgtcaatcttcatctatggcggctcgatcctgccgggctcgttccggggccggccggtcacggtgcaggatctgttcgaggcggtcggcaaggtcgccgtcggtgacatgagcctcgacgacctcgacgagctggagcgggtcgcctgcccctcggccggcgcctgcggcgcgcagttcaccgccaacaccatggccaccgtctccgaggcgatcggcctcgcgctgccctactcggccggcgcgcctgccccttatgagatccgcgaccaattctgcgccgccgccggcgagaaggtgatggagctgatcgccaagaacatccgcccgcgcgacatcgtcacccgcaaggccctggagaacgccgctgcgacggtcgcggcctcgggcggttcgaccaacgcggccctgcacctgccggcgatcgcgcatgaatgcggcatcgagttcaccctgttcgacgtcgccgagatcttccgcaagaccccctacatcgccgacctgaagcccggtgggcgctacgtggccaaggacatgttcgaggtcggcggcatcccgctgctgatgaagacgctgctcgaccacggctacctgcacggcgactgcctcaccgtcaccggccgcaccatcgcggagaacctcgccaaggtcgcctggaacccggatcaggacgtcgtgcgcccggccgataagcccatcaccgtcaccggcggcgtggtgggccttcgcggcaatctcgcccccgagggcgcgatcgtgaaggtcgccggcatgccgcccgaggcccaggtcttcaccggcccggcccgcgtcttcgacggcgaggaagcctgtttcgaggcggtgcagaaccgcacctacaagcccggcgacgttctggtcatccgttacgagggcccgaagggaggccccggcatgcgcgagatgctctcgaccaccgccgccctctacggccagggcatgggcgacaaggtggccctcatcaccgacgggcgcttttccggcgcgacccgcggcttctgcgtcggccatgtcggccccgaggctgccatcggcgggccgatcggcctgctgcgcgacggcgacatcatcaccctcgacgcgatcaagggcacgctcgacgtggcgctctccgacgaggaactggcccagcgtcgcagcgaatgggcgccgcggggcaatgccgcgacctccggctacctctggaaatatgcgcagtccgtcggacctgcggtgaacggggccgtgacgcatccgggcggcgcgggggagacgaacgtctatgccgacatctag

SEQ ID NO: 386 - protein, 576 aa, Methylobacterium chloromethanicum
MDARQTDKSKLPSRHVTEGPERAPHRSYLYAMGLTTEQIHQPLVGVASCWNEAAPCNISLMRQAQAVKKGVAAAKGTPREFCTITVTDGIAMGHGGMRASLPSREVIADSVELTIRGHSYDALVGLAGCDKSLPGMMMAMVRLNVPSIFIYGGSILPGSFRGRPVTVQDLFEAVGKVAVGDMSLDDLDELERVACPSAGACGAQFTANTMATVSEAIGLALPYSAGAPAPYEIRDQFCAAAGEKVMELIAKNIRPRDIVTRKALENAAATVAASGGSTNAALHLPAIAHECGIEFTLFDVAEIFRKTPYIADLKPGGRYVAKDMFEVGGIPLLMKTLLDHGYLHGDCLTVTGRTIAENLAKVAWNPDQDVVRPADKPITVTGGVVGLRGNLAPEGAIVKVAGMPPEAQVFTGPARVFDGEEACFEAVQNRTYKPGDVLVIRYEGPKGGPGMREMLSTTAALYGQGMGDKVALITDGRFSGATRGFCVGHVGPEAAIGGPIGLLRDGDIITLDAIKGTLDVALSDEELAQRRSEWAPRGNAATSGYLWKYAQSVGPAVNGAVTHPGGAGETNVYADI

SEQ ID NO: 387 - protein, 557 aa, Burkholderia ambifaria AMMD PRT
MPYNRRSKHITQGVARSPNRSMYYALGYQKDDFDKPMIGIANGHSTITPCNSGLQRLSDAAVAAVKAADANPQIFGTPTISDGMSMGTEGMKYSLVSREVIADCIETCVQGQWMDGVVVVGGCDKNMPGGMIALARLNVPGIYVYGGTIRPGHWKGRDLTIVSSFEAVGEFTAGRMSQEDFEGVEKNACPTSGSCGGMYTANTMSSSFEALGMSLLYSSTMANPDQEKVDSAAESARVLVEAVKRDLKPRDIITKASIENAVSLIMATGGSTNAVLHYLAIAHAAEIDWTIDDFERIRKRVPVLCDLKPSGQYVATDLHQAGGIPQVLRILLDAGLLHGDCMTITGRTIAEELKDVPGVPRADQKVIFPIDRALYKEGHLAILKGNLAEHGAVAKITGLKNPVITGPARVFDDEQSAMDAILADRIRAGDVLVLRYLGPQGGPGMPEMLAPTSAIIGKGLGESVGFITDGRFSGGTWGMVVGHVAPEAFVGGTIALVQEGDSITIDAHRRVLQLNVDDAELARRRAAWKQPAPRYTRGVLAKYAALARPANQGAVTG

SEQ ID NO: 388 - DNA, 1674 bp, Burkholderia ambifaria
atgccgtacaaccgtcgctcgaagcacatcacgcaaggcgtggcccgttcgccgaaccgctcgatgtattacgccctcggctaccagaaggacgatttcgacaagccgatgatcggcatcgcgaacggccactcgacgatcacgccgtgcaactcgggcctgcagcggctgtcggacgcggccgtcgcggcggtcaaggcggccgacgcgaacccgcagatcttcggcacgccgacgatctcggacggcatgtcgatgggcaccgaggggatgaagtactcgctcgtgtcgcgtgaagtgatcgccgattgcatcgagacctgcgtacagggccagtggatggacggcgtggtggtggtcggcggctgcgacaagaacatgccgggcgggatgatcgcgctcgcgcgcctgaacgtgccgggtatctacgtgtacggcggcacgatccgccccggccactggaagggccgcgacctgacgatcgtgtcgtcgttcgaggcggtcggcgaattcaccgcgggccggatgtcgcaggaggatttcgaaggggtcgagaagaacgcgtgcccgacctcggggtcgtgcggcgggatgtacacggcgaacacgatgagctcgtcgttcgaggcgctcggcatgtcgctgctgtactcgtcgacgatggcgaaccccgatcaggagaaggtcgattcggccgccgaatcggcgcgtgtgctggtcgaggccgtgaagcgcgaccttaagccgcgcgacatcatcacgaaggcatcgatcgagaacgcggtgtcgctgatcatggccaccggcggctcgaccaacgcggtgctgcactatctcgcgatcgcgcacgcggccgagatcgactggacgatcgacgacttcgagcgcatccgcaagcgcgtgccggtgctctgcgacctgaagccgtcgggtcagtacgtcgcgaccgatcttcaccaggcgggcggcatcccgcaggtgctgcgcatcctgctcgatgcggggctgctgcacggcgactgcatgacgatcaccggccgcacgatcgccgaggaattgaaggacgtgccgggcgtgccgcgcgcggaccagaaggtgatcttcccgatcgatcgcgcgctgtacaaggaagggcatctcgcgatcctgaagggcaacctcgcggaacacggcgcggtcgcgaagatcaccggcctgaagaacccggtgatcacgggcccggcccgcgtgttcgacgacgagcaaagcgcgatggacgcgatcctcgccgaccggatccgcgcgggcgacgtgctggtgctgcgctatctcggcccacagggcggccccggcatgccggaaatgctcgcgccgacgtcggcgatcatcggcaaggggctcggcgaatcggtcggcttcatcacggacggccgcttctcgggcggcacctgggggatggtggtcggccacgtcgcgccggaggcgttcgtcggcggcacgatcgcgctcgtgcaggaaggcgattcgatcacgatcgatgcgcaccggcgggtgctgcaactgaacgtcgacgacgcggagctcgcgcgccgccgcgccgcgtggaagcagccggcgccgcgctacacgcgcggcgtgctggccaagtatgcggccctcgcccgcccggcgaaccagggcgccgtcaccggttga

SEQ ID NO: 389 - protein, 574 aa, Bradyrhizobium sp.
MDAKTDIKRRLPSRHVTEGPERAPHRSYLYAMGLTTAQIHQPFVGVASCWNEAAPCNIALMRQAQAVKKGVAHAGGTPREFCTITVTDGIAMGHDGMRSSLPSRETIADSVELTIRGHAYDALVGLAGCDKSLPGMMMAMVRLNVPSIFIYGGSILPGNFRGQQVTVQDMFEAVGKHSVGQMSDDDLDELERVACPSAGACGAQFTANTMATVSEAIGLALPYSAGAPAPYEIRDSFCMTAGEKVMELIAANIRPRDIVTRAALENAAAVVAASGGSTNAALHLPAIAHEAGIKFDLFDVAEIFKKTPYIADLKPGGRYVAKDMFEAGGIPLLMKTLLDHGYLNGDCLTVTGRTIAENLKGVKWNPHQDVVRSADQPITATGGVVGLKGNLAPEGAIVKVAGMSNLKFSGPARCFDREEDAFEAVQKRTYREGDVIVIRYEGPRGGPGMREMLQTTAALTGQGMGGKIALITDGRFSGATRGFCIGHIGPEAAIGGPIALVEDGDIIEIDAVAGRLDVKLSDAELAARKTKWTPRETQHTSGALWKYAQQVGPAVAGAVTHPGGAQEKHCYADI

SEQ ID NO: 390 - DNA, 1725 bp, Bradyrhizobium sp.
atggacgcgaagaccgacatcaagcgcaggctgcccagccgtcacgtgacggaagggcccgagcgtgcgccgcatcggtcctatctctacgcgatgggcctcaccacggctcagatccatcagcccttcgtcggcgtcgcctcgtgctggaacgaggccgcgccgtgtaacatcgcgctgatgcggcaagctcaggccgtcaagaagggcgttgcccacgccggcggcacgccgcgcgagttttgcaccatcaccgtcaccgatggcatcgcgatgggccatgacggcatgcgctcgtcgctgccctcgcgcgagacgatcgctgattccgtcgagctgacgattcgcggtcatgcctacgacgcgctcgtcggtctggccggctgcgacaagtcgctgccgggcatgatgatggcgatggtccggctcaacgtgccgtcgatcttcatctatggcggctcgatcctgcccggcaatttccgcgggcagcaggtcaccgtgcaggacatgttcgaggccgttggcaagcattcggtcggccagatgtcggacgacgatctcgatgagctcgagcgcgtcgcctgtccgtcggccggcgcctgtggcgcgcagttcacggccaacacgatggcgacggtctccgaggcgatcggactggcgctgccctattcggccggggctccggcgccttacgagatccgcgattcgttctgcatgaccgcgggcgagaaggtgatggagctgatcgcggccaacatccggccgcgcgacatcgtcacgcgggcggcgctggagaatgcggcggccgtcgtcgcggcctccggcggctcgaccaacgctgcgctgcacctaccagcgattgcacacgaggcaggtatcaagtttgacctgtttgatgtcgccgaaatcttcaaaaagacaccttatatcgcggatttgaagccaggtggccgctatgtcgccaaagacatgttcgaggctggtggtattccgcttctgatgaagacgttgctcgaccatggctatttgaatggcgactgcctcacagtcaccggccggacgatcgccgaaaacctcaaaggcgtgaaatggaatccgcaccaggacgtggtgaggtcggctgatcagccgatcactgcgaccggtggtgttgtcggtctgaaaggcaatctcgcgccagagggtgcgatcgtgaaagtcgcgggcatgtcgaacttgaaattctctgggccggcccgctgcttcgatcgggaagaggatgcctttgaggcggtgcagaagcggacctatcgcgaaggcgatgtcatcgtcatccgctatgaggggccgcgcggcggtcccggcatgcgggagatgctgcagaccacggcggcgctcaccggacagggcatgggcggcaagatcgcgctgatcaccgacggccggttctcgggcgcgacccgtggcttctgcatcggccatatcggaccggaggccgccatcggggggccgatcgccctcgtcgaagacggcgacattatcgaaatcgacgccgtcgcagggcgtctcgacgtcaagttgagtgatgccgaactcgcggcacgcaagaccaagtggacgccgcgtgagacacagcacacgtcaggtgcgctttggaaatatgcccagcaggtggggccggccgttgcgggcgccgtgacccatccaggtggtgcgcaagagaaacattgctatgcggacatctga

SEQ ID NO: 391 - protein, 658 aa, Delftia acidovorans
MQGGDSRATRSGVNAHREIRRPRYGGRLFSVPRMNQKPASPDNVFSESSASASLAASTATTSTTGSSPAAATPKPTPKPTPKPTPFRSALIRSGTIRATTRSFLHALGQDDEDIERPHIGVFHTGGEMSPCNLNLRDQAQHAKTGIYAGGGTPHECPVVSVSDGLTMAHSGMRFSLVSRELIADSVEASVRGHQWDGIFAIGACDKNLPGLMMGMVRCNVPSVFVHGGSALPGQAPGVHGRDLNVVDTYETIGQVLAGTATAQDLEAMSRACLPTAGACAGQFTANTMGMVSEALGLAPIGSSMVPAVFSERAPLMRRAARQLMQAVWASAEGGGPLPRDIITRRALENACAVVSATGGSTNAALHLPAIAHEAGIRFHLDDVAEIFARTPLIADLRPGGRFLARDVYYIGGAGVILRTLMEQGFVHGDALTFTGRTLAEELADAAPPDGEVVRTPGNPITRDGGLTVLKGNLCPDGALLKTAGLKTLVHRGPARVFESEEQAQAAVQAMQYAAGDVIVIRNEGPRGSPGMREMLGITALLYGQGMGDKVALLTDGRFSGATRGLCIGYAGPEAADNGPIAALRDGDLIAIDARADARSITVEIGEAELAARLEQSAAARRQAPPLGGVLEKYALTVRPAHQGAVTHSGQVVWLRDDS

SEQ ID NO: 392 - DNA, 1977 bp, Delftia acidovorans
ttgcagggcggcgactcccgggcgacacgatctggtgtaaatgctcatagggaaatccgcagaccccgctatggtgggcggctgttttccgtcccgcgtatgaaccagaaacctgcctcccccgacaacgtcttttccgagtccagcgcctccgcatcgctggccgcctccaccgccacaaccagcaccaccggcagcagcccggcagcggccacgcccaagcccacgcccaagcccacgcccaagcccacgccctttcgctccgccctgatccgctccggcaccatccgtgccaccacgcgcagcttcctgcatgccctgggccaggacgacgaagacatagagcgcccgcacatcggcgtgttccacacgggcggggagatgagcccctgcaacctcaacctgcgcgaccaggcccagcatgccaagaccggcatctatgccgggggcggtacgccgcatgaatgcccggtggtgtcggtcagcgacgggctgaccatggcgcattcgggcatgcggttttcgctggtctcgcgcgagttgatcgccgacagcgtggaggcctcggtgcgcggccaccagtgggatggcatcttcgccatcggcgcctgcgacaagaacctgccggggctgatgatgggcatggtgcgctgcaatgtgcccagcgtcttcgtgcatggcggctcggccctgccggggcaggcgcccggcgtgcacgggcgcgacctgaacgtggtcgatacctacgagaccatcggccaggtgctggccggcaccgccacggcgcaggacctggaggccatgagccgcgcctgcctgcccacggccggcgcctgcgcaggccagttcacggccaacaccatgggcatggtgagcgaggcgctgggcctggcgcccatcggctccagcatggtgcccgccgtgttcagcgagcgcgcaccgctgatgcgccgcgccgcgcgccagctcatgcaggccgtgtgggccagcgccgaaggcggcggcccgctgccgcgcgacatcatcacgcgccgggcgctggagaatgcctgcgccgtggtcagcgccacgggcggatcgaccaatgccgccctgcacctgccggccatcgcgcatgaggccggcatccgcttccacctggacgacgtggccgagatcttcgcgcgcacgccgctgatcgccgacctgcgtcccggcgggcgcttcctggcgcgcgatgtgtactacatcggcggcgccggcgtgatcctgcgcacgctgatggagcagggctttgtccacggcgatgcactcaccttcacgggccgcaccctggctgaagaactggccgatgccgcgccgcccgatggcgaggtggtgcgcacgcccggcaatcccatcacgcgcgacggtggcctgaccgtgctcaagggcaacctctgccccgatggcgcgttgctgaagacggccggcctcaagaccctggtgcaccggggccccgcgcgcgtcttcgagtccgaggaacaggcccaggccgccgtgcaggccatgcagtacgcggccggcgatgtcatcgtcatccgcaacgaaggcccgcgcggcagccccggcatgcgcgagatgctgggcatcaccgcgctgctgtatggccagggcatgggcgacaaggtggccctgctgaccgatgggcgcttctctggtgccacgcgcggcctgtgcatcggctacgcaggccccgaggccgccgacaacggccccattgccgcgctgcgcgacggcgacctcatcgccatcgacgcccgcgccgatgcgcgcagcatcacggtggaaatcggcgaggcggaactggccgcacgcctggaacaatcggccgccgcgcgccgccaggccccgccgctgggcggcgtgctggaaaaatacgcgctcaccgtgcgcccggcccaccagggcgcggtcacgcattcgggccaggtggtctggctgcgcgacgacagttga

SEQ ID NO: 393 - protein, 561 aa, Microcystis aeruginosa
MADNYRSRIVTQGTQRSPNRAMLRAVGFGDEDFSKPIIGIANGFSTITPCNMGINDLAMRAEAATRLAGGMPQLFGTITISDGISMGTEGMKYSLVSREVIADSIETVCNGQSLDGVLAIGGCDKNMPGAMIAMARMNIPAIFVYGGTIKPGRYKDCDLTVVSSFEAVGQYSAGKISEEDLIGIERNACPGAGSCGGMFTANTMSSIFEAMGMSLPYSSTMAAEDAEKADSTEESAKVLVEAVRKQILPSQILTRKAFENAISVIMAVGGSTNAVLHLLAISRTIGVELSIDDFETIRQRVPVICDLKPSGRYVTVDLHKAGGIPQVMKILLVNGLLHGDALTISGQTIAEILADIPDQPPSGQDVIRPFSNPVYKEGHLAILKGNLATEGAVAKISGVKTPVITGPARVFESEETCLEAILAGKIQAGDVVVVRYEGPVGGPGMREMLAPTSAIIGAGLGDSVGLITDGRFSGGTYGMVVGHVAPEAAVGGTIALVEEGDQITIDARQRLLSLNVSEEELTRRRNHWQPRPPRYKTGILGKFAKLVSSSSLGALTDLNLF

SEQ ID NO: 394 - DNA, 1686 bp, Microcystis aeruginosa
atggcagataactacagaagtcgcattgttacccaaggtacccaacgcagtcctaatcgggccatgttaagagcggtaggttttggggatgaggactttagcaaaccaatcatcggcatcgctaacggatttagcaccattaccccctgtaacatgggaattaatgatttagcaatgcgtgccgaagcagccacgagattagcggggggaatgccgcaacttttcgggactatcaccattagtgacgggatttccatgggaacagaagggatgaaatattctctcgtttctagggaagtaatcgccgattccattgaaaccgtctgtaatggtcaaagtctcgatggagtcctcgctatcgggggttgtgacaaaaatatgccgggggcaatgattgccatggcccggatgaatattcccgctattttcgtctatggtggcacgattaaaccggggcgctacaaagattgcgatttaaccgtggtcagttcctttgaagccgtgggacagtacagcgccggtaaaatcagtgaagaagacctcatcggaattgaacgcaacgcttgccccggtgctggttcctgtggtggaatgtttactgctaataccatgtcttccatttttgaagccatggggatgagtttaccctattcctcaaccatggccgccgaagatgcggaaaaagccgatagtaccgaagaatcggccaaggttttggtcgaggcggttagaaaacagattctccctagccaaattttgacccgtaaagcctttgaaaacgccatttcggtaattatggcggtgggaggttccactaacgctgtgctgcaccttttagccatttcccgcaccatcggggtagaattatcgatcgatgattttgaaaccatccgccagcgtgtaccggttatctgcgatcttaaaccctccgggcgttacgttaccgtggatctgcacaaagccggcggtattccccaagtgatgaaaattctcctggttaatggtttactgcacggggatgccctcaccattagcggtcagactatcgccgagattttagccgatattcccgaccaaccgccctcaggccaagatgttatccgtccttttagcaatcctgtctataaagagggtcatttagccattttaaaaggaaatctggccacagagggggccgtggccaaaattagcggcgtgaaaactccggtaatcaccggaccggcgcgggtgtttgaatcggaagaaacctgtttagaggcaattttagccggaaaaattcaagccggggatgtggtggttgtccgttacgagggaccagtaggcggaccgggtatgcgggaaatgttggcccccacttcggcaattatcggcgccggtttaggggattccgtgggattaattaccgatggtcgtttttccgggggaacctacggcatggtggtcggtcacgtcgctccagaagcggcggtgggtggtacaattgccctagtagaggagggggatcaaatcactattgatgctcgtcagcgtctcttgagtttaaatgtatcggaagaagaattaacccgtcgtcgtaaccattggcaaccgcgccccccacgctataaaacgggaattctcggcaaattcgccaagttagtctcctctagcagtctcggcgctttaacggatctgaatctgttctaa

SEQ ID NO: 395 - protein, 571 aa, uncultured marine microorganism
MAAISQTRSILAMTTEARSKLKRKSHVVSEGPARAGARAMLRAVGLKDEDMDKPFVAVANLASDVTPCNVHLDRLAQKVKQGVWDANGVPFLFGTITVSDGISMGTEGMKASLVSREVIADSIETVAFAESMDGLIVVAACDKNMPGAIMAMARLNIPALFVYGGTILPGHYRGEDINIQDMYEAVGAYSQGKLTEEELLAMERVACPGEGACAGMFTANTMASAIEALGMSVPGAASIPAVDPRVEDVAHDAGAVLYNLLERDIKPRDILTREALENAITVVLAMGGSTNAVLHLLAIAHEAEVPLDIDDFDRLSSRTPYLTDLRPAGRFVMSDVDKAGGVPVVMRELLKAGLLHGDVMTITGKSLAENLQAFDREPDSRVIYPVSSPRSPTGGLVILKGNLAPEGGVMKVSGTKHHVHEGPARVFDGERAAFDAVTRGDIVDGDVVVVRYEGPKGGPGMQEMLAVTGAIIGQGLGDSVMLLTDGRFSGATHGPMIGHVAPEAAVGGPIALLRDGDTVALNVEARELSVKLSDEEMARRRGEWAAPPPRYQKGVMAKYAKLVSSASVGAV

SEQ ID NO: 396 - DNA, 1712 bp, uncultured marine microorganism
atggcggccataagccaaaccaggagtattttagccatgactaccgaagcaaggtccaaactcaagcgcaagagccacgtggtgagcgaaggcccggccagggccggggcccgcgccatgctccgcgctgtgggcctcaaagacgaggacatggacaagcccttcgtcgccgtggccaaccttgccagcgacgtgacgccctgcaacgtccacctggacaggctggcccagaaggtcaagcagggcgtgtgggatgccaacggtgtacccttcctcttcggcacaataaccgtcagcgatggcatctccatgggcaccgaaggaatgaaggcctccctggtcagccgggaggtcatcgccgattccatcgagacggtggccttcgccgagagcatggacggactgatagtggtcgccgcctgcgacaagaatatgcccggtgccatcatggcgatggcaaggctcaatatcccggcgctgttcgtgtatgggggcaccattcttcccgggcattacaggggcgaagacatcaacatccaggatatgtacgaggccgttggcgcctattcccagggcaagctgacggaggaggagctattggccatggagcgcgtggcctgccctggcgagggggcgtgtgccggaatgttcaccgccaacaccatggcctcggcaatcgaggcgctgggcatgtctgtgccgggcgcggcctccattccggcggtggacccccgcgtcgaggacgtagcccatgacgctggcgcggtgctctacaacctgctggagagggacatcaagccccgtgacatcttaacgcgagaggctctcgagaacgccatcaccgtcgtgctggcaatgggcggttccaccaacgccgttctacacctgctggctatcgcccacgaagccgaagtgcctctggacatagacgacttcgaccgcctcagcagccgcactccctatctcaccgatctccgcccggccgggcgctttgtgatgtctgatgtggacaaggccggcggcgtcccggtggtgatgagggagctgctcaaagcaggtcttctccacggcgatgtgatgaccattacgggcaagagcctcgccgagaacctgcaagccttcgatcgagagcccgacagccgggtgatctaccccgtgtcctcgcctcgcagccccacgggtgggctggtgatcctgaagggcaaccttgcccctgagggtggggttatgaaggtatcggggaccaagcatcacgtccacgaagggccggcccgggtctttgacggcgagcgggccgccttcgacgcggtcacccgaggagatatcgtggacggcgatgtggtggtcgtccggtacgagggccccaagggaggcccgggcatgcaggagatgttggctgtaaccggcgccatcattggtcagggcctgggcgacagcgtcatgcttctaaccgatggtcggttctccggcgcgacccacgggcccatgataggccacgtggcccccgaggccgcggtgggcggccccatcgccctgctgcgggacggtgataccgtcgccttgaacgtcgaggccagggagctgagcgtcaagctctctgacgaggagatggctcggcgtcgcggcgagtgggcggctccccctccgaggtaccagaagggagtgatggccaagtacgccaagctggtgtcgtcggcctctgtcggggcagt

SEQ ID NO: 397 - protein, 557 aa, Burkholderia ubonensis
MSYNRRSKNITQGVARSPNRSMYYALGYRKEDFDKPMIGIANGHSTITPCNAGLQRLSDAAVAAVKDAGANPQIFGTPTISDGMSMGTEGMKYSLVSREVIADCIETCAQGQWMDGVVVVGGCDKNMPGGMIALARLNVPGIYVYGGTIRPGHWKGRDLTIVSSFEAVGEFTAGRMSQEDFEGVEQNACPTTGSCGGMYTANTMSSSFEALGMSLLYSSTMANPDQEKVDSAAESARVLVEAVKRDLKPRDIITRQSIENAVSLIMATGGSTNAVLHYLAIAHAAEVDWTIDDFERIRKRVPVICDLKPSGQYVATDLHQAGGIPQVLKILLDAGLLHGDCMTITGRTLADELKDVSSAPRADQKVIFPIAQALYKEGHLAILKGNLAQDGAVAKISGLKNPVITGPARVFDDEQSAMEAILGDRIHAGDILVLRYLGPQGGPGMPEMLAPTSAIIGKGLGESVGFITDGRFSGGTWGMVVGHVAPEAFVGGTIALVQEGDSITIDAHRLLLQLNVDDAELARRRAAWKQPAPRYTRGVLAKFAALARPANQGAVTG

SEQ ID NO: 398 - DNA, 1674 bp, Burkholderia ubonensis
atgtcatacaaccgccgctcgaagaacatcacgcagggcgtggcccgttcgccgaaccgctcgatgtattacgcgctcggctaccggaaggaagatttcgacaagccgatgatcggcatcgccaacggccattcgacgatcacgccgtgcaacgcgggcctgcagcgcctgtcggacgcggcggtcgcggccgtgaaggacgccggcgcgaatccgcagatcttcggcacgccgacgatctcggacggcatgtcgatgggcacggaggggatgaagtactcgctcgtgtcgcgcgaagtgatcgccgactgcatcgaaacctgcgcgcagggccagtggatggacggcgtggtcgtcgtcggcggctgcgacaagaacatgccgggcgggatgatcgcgctcgcgcgcctgaacgtgccgggcatctacgtgtacggcggcacgatccgcccgggccactggaagggccgcgacctgacgatcgtgtcgtcgttcgaggcggtcggcgagttcaccgcgggccggatgtcgcaggaggatttcgaaggggtcgagcagaacgcgtgcccgacgacgggctcgtgcggcggcatgtacaccgcgaacacgatgagctcgtcgttcgaggcgctcggcatgtcgctgctgtattcgtcgacgatggcgaacccggaccaggaaaaggtcgactccgcggccgaatcggcgcgcgtgctggtcgaagcggtcaagcgggacctgaagccgcgcgacatcatcacgaggcagtcgatcgagaacgcggtgtcgctgatcatggcgaccggcggctcgaccaacgcggtgctgcactatctggcgatcgcgcacgcggccgaggtcgactggacgatcgacgatttcgagcgcatccgcaagcgcgtgccggtgatctgcgacctgaagccgtcgggccagtacgtcgcgaccgacctgcaccaggccggcggcattccgcaggtgctgaagatcctgctcgacgccggcctcctgcacggcgactgcatgacgatcacgggccgcacgctcgccgacgagctgaaggacgtgtcgagcgcgccgcgcgcggaccagaaggtgatcttcccgatcgcgcaggcgctgtacaaggaaggccacctcgcgattctgaagggcaacctcgcgcaagacggcgcggtcgcgaagatctccggcctgaagaacccggtcatcacgggcccggcgcgcgtgttcgacgacgagcagagcgcgatggaggcgatcctcggcgaccggatccacgccggcgacatcctcgtgctgcgctacctcggcccgcagggcggcccggggatgccggagatgctcgcgccgacctcggcgatcatcggcaagggcctcggcgaatcggtcggcttcatcaccgacggccggttctccggcggcacctgggggatggtggtcggtcacgtcgcgccggaggcgttcgtcggcggcacgatcgcgctcgtgcaggaaggcgattcgatcacgatcgacgcgcaccggctgctgctgcagttgaatgtcgacgatgccgaactggcgcgccgccgcgctgcatggaagcagcccgcgccgcgctacacgcgcggcgtgctcgcgaagttcgccgcgctcgcccgcccggcgaaccagggcgccgtcaccggctga

SEQ ID NO: 399 - protein, 560 aa, Gemmata obscuriglobus
MSDGPTRTSLITTGGQGRAPNRAMLRAVGFTDEDFDRPVIGVASLFSDITPCNAHLNRLAEKGREGVRAAGGVPQTFGAPTVSDGISMGHRGMRYSLVSREVIADAIETVCGAMNHDGLVAFGGCDKNMPGCVMAMARLNIPSVFVYGGSIMPGVGAHGEDLDIVSIFEAVGQFQAGKIDQKALHKVECESCPGHGSCGGMYTANTMSSAIEAMGLSLPYGASNPAVTAAKDRESFLAGKAVLRCVEKNIRPRDIITRKSLENAYTFVLALGGSTNAVLHLMAIAREAGVEWTLEDFDRISAKTPHLADLKPGGKYVMFDLYRVGGTPAVLKALLDNGFLHGDCITVTGQTLAENLKDVPSVFEKPQKVVKRFEEPLFSHGIHVVLKGNLAPEGAVAKVAGLKQRSITGPAKVFDGEEACFAAIQARKIVAGDVVVIRGEGPVGGPGMREMLSITGALMGQGLGETVGLITDGRFSGGTHGLVVGHVAPEAWVGGPIALIHDGDSITIDGDAKTLTLNIPDAELQARKDQWKAPALRVTGGVLAKYAKLARSASEGAGTG

SEQ ID NO: 400 - DNA, 1683 bp, Gemmata obscuriglobus
atgtctgatggtcccacccgtaccagcctgatcaccaccggcggccagggccgcgcgccgaaccgcgcgatgctccgggcggtcgggttcaccgacgaggacttcgaccggccggtgatcggggtcgcgtcgctgttcagcgacattaccccgtgcaacgcgcacctgaaccggctcgcggagaaggggcgcgagggggtgcgcgccgccggcggcgtcccccagacgttcggcgcgccgaccgtgtccgacgggatcagcatggggcaccgcgggatgcggtactcgctggtgagccgcgaggtgatcgcggacgccatcgagaccgtgtgcggggcgatgaaccacgacgggctggtcgcgttcggcgggtgcgacaagaacatgcccggctgcgtcatggcgatggcccggctcaacatcccgagcgtgttcgtctacggcggcagcatcatgccgggcgtcggggcgcacggcgaggacctcgacatcgtctcgattttcgaggccgttggtcagttccaggcgggcaagatcgaccaaaaggcgctccacaaggtggagtgcgagagttgcccgggtcacggctcgtgcggcggcatgtataccgccaacacgatgtccagcgcgatcgaagcgatgggcctgtcgctgccttacggggcgagcaacccggcggtgaccgccgcgaaggaccgcgagtcgttcctggccggtaaggcggtgttgcggtgcgtcgagaagaacatccgcccgcgcgacatcatcacccgcaagagcctggaaaacgcctacacattcgtgttggctctgggcggcagtacgaacgcggtgctgcacctgatggcgatcgcgcgtgaggcgggcgtcgagtggacgctcgaggacttcgaccgcatcagcgcgaagacgccgcacctcgcggacctgaagccgggcggcaagtacgtgatgtttgacctgtaccgcgtgggcggcacgcccgcggtgctgaaggcattgctggacaacggcttcctgcacggcgactgcatcaccgtgaccggccagacgctcgcggagaacctcaaagacgtgcccagcgtgttcgagaagccgcagaaagtggtaaagcggttcgaggagccgctcttcagccacgggattcacgtggtgctgaagggcaacttggcgcccgaaggagcggtcgcgaaggtggcaggcctgaagcaacgcagcatcaccggcccggccaaggtgttcgacggcgaggaggcgtgtttcgccgccatccaggcgcggaagatcgtcgcgggcgatgtggtcgtgatccgcggtgaggggccggtcggcggtcccgggatgcgcgagatgctgagcatcaccggcgcgctaatgggccaggggctgggcgagacggtggggctcatcaccgacggccggtttagtggtggtacgcacgggctggtggtcggacacgtcgcgcccgaggcctgggtgggtggcccgatcgcactcatccacgacggcgactcgatcaccatcgacggcgacgccaagaccctcacgctcaacattcctgacgcggaactgcaagcgcggaaggatcagtggaaggcgccggcgctgcgggtgacgggcggggtgttggcgaagtacgcgaagctggcccgctctgccagcgaaggcgccgggaccgggtga

SEQ ID NO: 401 - protein, 578 aa, Mycobacterium abscessus
MSAPHKPDSLRASGSSQPDIKPRSRDVTDGLEKTAARGMLRAVGMGDDDWVKPQIGVGSSWNEITPCNMSLQRLAHSVKDGVHEAGGYPLEFGTISVSDGISMGHEGMHFSLVSREVIADSVETVMQAERLDGSVLLAGCDKSIPGMLMAAARLDLASVFLYNGSIMPGKAKLTDGTEKEVTIIDAFEAVGACARGLMSREDVDIIERAICPGEGACGGMYTANTMASAAEALGMSLPGSASPVAIDKRREEYARKSGEAVVEMLRRGITARDILTKEAFENAIAVVMAFGGSTNAVLHLLAIAKEAEVELSLADFTRIGNKVPHLADVKPFGRHVMKDVDEIGGVPVVMRALLDAGLLHGDCLTVTGKTMAENLAHIAPPDPDGKVLRAMNDPIHPTGGITILHGSLAPEGAVVKSAGFESDVFEGTARVFERERAALDALEDGTITHGDVVVIRYEGPKGGPGMREMLAITGAIKGAGLGKDVLLMTDGRFSGGTTGLCVGHIAPEAVDGGPIAFVRDGDRIRLDVANGKLDLLVDEAEIAERRKGFEPLPPRYKTGVLAKYTKLVQSAAVGAVCG

SEQ ID NO: 402 - DNA, 1737 bp, Mycobacterium abscessus
atgtcagccccgcacaagcctgattctcttcgcgcaagcggctcatcgcagcccgatatcaagccccgtagccgcgacgtcaccgacggcctggagaagaccgccgcccgcggaatgctgcgcgcggtaggcatgggcgacgacgactgggtcaaaccgcagatcggtgtcggctcgtcctggaacgaaatcaccccgtgcaacatgtcgctgcaacggctggcgcattcggtgaaggacggcgtgcacgaggccggtggctatccgctggagttcggcaccatctcggtgtccgacggcatctccatggggcacgagggcatgcacttctcgctggtttcacgcgaagtcatcgccgacagcgtcgagaccgtgatgcaggccgagcgcctcgatggatccgtgctgctggccggatgcgataagtcaatacccggaatgctcatggccgcagcacgtttggacttggcctcggtgttcttgtacaacggctcgatcatgccgggcaaggccaagttgaccgacggtactgagaaggaagtcaccatcatcgacgccttcgaggcggtcggcgcctgcgcgcgcgggctgatgtcacgcgaggacgttgacatcatcgaacgcgccatctgtccgggtgagggcgcctgcggcggcatgtacaccgccaacaccatggccagcgccgccgaggcgctgggaatgtccttgccgggcagcgcctctccggtcgccatcgacaagcgccgcgaggagtacgcacgcaagtccggcgaggctgtcgtcgagatgctgcgccgcgggatcaccgcgcgcgacatcctcaccaaggaggccttcgagaacgccatcgccgtggtgatggcgttcggcggctccaccaacgcggtgctgcatctgctggccatcgccaaagaggctgaggtcgaactgtcgctggccgacttcactcgcatcggcaataaggtgccgcatctggcagacgtcaaaccctttggccgccacgtgatgaaggatgtcgacgagatcgggggcgtgcccgtggtgatgcgcgcgctcttggatgccggcctgctgcacggcgattgcctgaccgtcaccggcaagacaatggccgagaacctggcgcatatcgccccaccggacccggacggcaaggtgctacgtgccatgaacgacccgatccacccgaccggcggcatcaccatcctgcacggttcattggctcccgagggagccgtggtgaagtcggccggcttcgaatccgacgtcttcgagggcaccgcaagggttttcgagcgcgaacgagcggccctggacgcgctcgaggacggcaccatcactcatggcgacgtcgtcgtgatccgctatgaaggccccaagggcggccccggcatgcgcgagatgctggcgatcaccggagccatcaagggcgccggcctgggcaaggatgtgctgctgatgaccgacgggcgcttctccggcgggaccaccggcctctgcgtcgggcatatcgctccagaagccgtggacggcggacccatcgcctttgtccgggacggtgaccggatccgcctcgatgtcgcgaacggcaagctcgacctgctggtcgacgaggccgagatcgccgagcgccgtaaggggttcgaaccgctaccgccgcgctacaagacgggcgtgctggccaagtacaccaagctggtgcagtcggcggcggtcggcgcggtctgcggctaa

SEQ ID NO: 403 - protein, 561 aa, Synechococcus sp.
MSDNRRSRVVTEGHQRSPNRAMLRAVGFGDDDFSKPIVGLANGYSTITPCNMGINDLAQRADKAIREAGAMPQMFGTITISDGISMGTEGMKYSLVSRDVIADSIETACNGQSMDAVLAIGGCDKNMPGAVLAIARMNIPAIFVYGGTIKPGHLDGEDLTVVSAFEAVGEFSAGKIDEERLLAVEKNACPGAGSCGGMYTANTMSSAFEAMGISLPYSSTMAAEDEEKAVSAEESARVLVNAIKKQILPKDILTRKAFENAISVIMAVGGSTNSVLHLLAIANTIGVDLTIDDFETIRQRVPVICDLKPSGRYVATDLHKAGGIPQVMKMLLDHGLLHGDCLTITGKTVAETLADIPSEPSPDQDVIRPWDKPMYEKGHLAILKGNLAEEGSVAKISGVKNPRITGPARVFESEEECLDAILAGKIVAGDVVIVRYEGPKGGPGMREMLAPTSAIIGAGLGDSVGLITDGRFSGGTYGLVVGHVAPEAFVGGNIALVEEGDSITIDAHEKLLQINVPDEELAKRRAAWKPREPRYKRGVLGKYAKIVSTSSKGAVTDIDLF

SEQ ID NO: 404 - DNA, 1686 bp, Synechococcus sp.
atgagcgacaatcgacgtagccgggtagtcaccgaaggtcatcagcggagcccaaaccgcgccatgctccgggctgtgggctttggggatgatgattttagtaaaccaattgtgggcttggcgaatgggtacagtacgattacgccatgcaatatgggaatcaatgacctcgcccagcgagcggataaggcaatccgggaagcgggagcgatgccgcagatgtttgggacgatcaccattagtgatgggatctccatgggtacggaggggatgaagtattctttggtttcccgtgatgtgatcgctgactccattgagacggcttgtaatggccaaagcatggatgcggttctcgccattggcggttgtgataagaatatgccgggggcagtgttggcgatcgcccggatgaatatccccgcaatttttgtttacggtggcacgatcaaacccggtcatttagacggggaagatctcacagttgttagtgcgttcgaggctgtcggtgaatttagcgccggaaaaatcgacgaggaaagattattagccgttgagaaaaatgcttgtccgggggctggctcctgtggcgggatgtacacggccaatacgatgtcctcggcttttgaggcgatggggatcagtttgccctactcctcgacgatggccgctgaagatgaagaaaaagctgtcagtgcggaagagtcggcacgcgttttggtcaatgcgatcaagaagcagattttgccgaaggacatcctcacgcgcaaggcatttgaaaacgcgatttccgtaattatggccgtgggcggctcgacaaattcagtcttacatttgttggcgatcgccaatactatcggtgtggatctgaccatcgacgactttgaaaccatccgccagcgcgtccccgtcatctgtgacctcaagccctctggtcgctacgttgccaccgatctccacaaggcgggcggcattccccaggtgatgaaaatgctcttggatcacggtcttctccatggcgactgtctaacaattactggcaaaaccgtcgctgaaaccctcgccgatattcccagcgaaccctctcccgatcaggatgtgattcgtccttgggataagccaatgtacgaaaaaggacacctggcgatcctcaagggcaacttggccgaagaaggttccgtggcgaaaattagtggcgtgaaaaatccccggatcactggccccgcccgcgtttttgagtccgaagaagaatgtctcgatgcaatcctggctggcaagattgttgctggtgatgtggtgattgttcgttacgaagggccgaagggtggccccgggatgcgggaaatgctagcgcccacctccgcaattattggcgctggtctgggcgattctgtcggtctgatcaccgatggtcgtttctctggcggaacctatggtctcgtggtcggacacgttgccccggaagcgtttgtgggtggcaatattgcccttgtggaagaaggggacagcatcaccatcgatgcccacgaaaaactgttgcaaatcaatgttcctgatgaggaactggcaaaacgtcgcgccgcttggaaaccccgtgaaccccgttataagcgtggtgtccttggaaagtatgccaagattgtttccaccagtagtaaaggtgcagtgacagatatcgatttgttttaa

SEQ ID NO: 405 - protein, 557 aa, Burkholderia graminis
MPYNRRSKNITQGVARSPNRSMYYALGYQKEDFDKPMIGIANGHSTITPCNAGLQRLADAAVAAVKGTDANPQIFGTPTISDGMSMGTEGMKYSLVSREVIADCIETCVQGQWMDGVVVIGGCDKNMPGGMIGLARMNVPGIYVYGGTIRPGNWKGTDLTIVSSFEAVGEFTAGRMSEEDFEGIEKNACPSTGSCGGMYTANTMSSSFEALGMSLLYSSTMANPDHEKVDSAAESARVLVEAVKKDLKPRDIITKKSIENAVALIMATGGSTNAVLHYLAIAHAAEVEWTIEDFERIRKKVPVICNLKPSGQYVATDLHKAGGIPQVMKILLDAGLLHGDCITITGKTLAEELKDVPGKPRADQQVIFPIEKALYKEGHLAILKGNLAEDGAVAKITGLKNPVITGPARVFDDEQSALEAILADRIVAGDVVVLRYLGPKGGPGMPEMLAPTSAIIGKGLGESVGLITDGRFSGGTWGMVVGHVAPEAFVGGTIGLVQEGDSITIDAHRLLLQLNVDDAELQRRRAAWQQPKPRYTRGVLAKYSALALPANKGAVTG

SEQ ID NO: 406 - DNA, 1674 bp, Burkholderia graminis
atgccatacaaccgtcgttcgaagaacatcacgcaaggcgtggcccgttcgccgaaccgctcgatgtactacgcactcggctatcagaaggaagacttcgacaagccgatgatcggcatcgcgaacggccattcgacgatcacgccatgcaacgccggcctgcagcgtcttgccgacgccgccgtcgccgcggtcaagggcacggacgcgaatccgcagatcttcggcacgccgaccatctcggacggcatgtcgatgggcaccgaaggcatgaagtactcgctcgtctcacgcgaagtgatcgccgactgcatcgagacctgcgtacaaggtcagtggatggacggcgtggtcgtgatcggcggctgcgacaagaacatgcccggcggcatgatcggcctcgcgcgcatgaacgtgccgggcatctacgtgtatggcggcacgatccgtccgggcaactggaagggcaccgatctgaccatcgtgtcgtcgttcgaggcggtcggcgaattcacggcgggccgcatgtcggaagaggacttcgaaggcatcgagaagaacgcgtgcccgtcgacgggttcgtgcggcggcatgtacacggccaacacgatgagctcgtcattcgaagcgctcggcatgtcgctgctgtattcgtcgacgatggcgaaccccgaccacgaaaaggtcgactcggccgctgagtcggcgcgcgtgctcgtcgaagccgtcaagaaagacctgaagccgcgcgacatcatcacgaagaagtcgattgaaaacgccgtcgcgctgatcatggcgacgggcggctcgaccaacgcggtgctgcactatctggcgatcgcgcacgcggctgaagtggaatggacgatcgaggacttcgagcgcatccgcaaaaaagtgccggtgatctgcaatctgaaaccatcgggccagtacgtcgcgaccgacctgcacaaggccggcggcattccacaggtcatgaagattctgctcgacgcgggtctgttgcatggcgactgcatcaccatcacgggcaagacgctcgccgaagaactgaaggacgtgccgggcaagccgcgcgccgatcagcaggtgatcttcccgatcgagaaggcgctgtacaaggaaggccatctcgcgatcctgaagggcaatctcgccgaagacggcgcggtggcgaagatcacgggcctgaagaacccggtgatcaccgggccggctcgcgtgttcgacgacgagcaaagcgcgctcgaagcgattctggccgataggatcgttgccggcgatgtcgtcgtgctgcgctatctcggcccgaagggcggtccgggcatgccggaaatgctcgcgccgacgtcggcgattatcggcaaagggctcggcgaaagcgtcggcctcatcaccgacggacgcttttcgggcggcacatggggcatggtggtcggccacgtcgcgccggaagcgttcgtcggcggcacgatcgggctcgtgcaggaaggcgattcgatcaccatcgacgcacacaggttgctcttgcaactgaacgtcgacgacgccgaattgcagcgccgccgcgccgcctggcagcagccgaagccgcgctacacgcgcggcgtgctggcgaagtactcggcgctggcgttgccggccaacaagggggcggtcaccggttga

SEQ ID NO: 407 - protein, 576 aa, Methylobacterium radiotolerans
MVTRLNDKSKLPSRHVTEGPDRAPHRSYLYAMGLTREQIHQPLVGVASCWNEAAPCNISLMRQAQAVKKGVAAANGTPREFCTITVTDGIAMGHGGMRASLPSREVIADSVELTMRGHAYDALVGLAGCDKSLPGMMMAMVRLNVPSIFIYGGSILPGSFRGKPVTVQDLFEAVGKVAVGDMSLEDLDELEQVACPSAGACGAQFTANTMATVSEAIGLALPYSAGAPAPYEIRDKFCATAGEKVMELLEKRIRPRDIVTRKALENAATVVAASGGSTNAALHLPAIAHECGIEFTLFDVAEIFRRTPYIADLKPGGRYVAKDMFEVGGIPLLMKTLLDHGFMHGDCMTVTGRTIAENMDRVTWNPDQDVVYPANRPITPTGGVVGLKGNLAPEGAIVKVAGIPAEKQVFTGPARVFDGEEACFAAVQARSYKEGDVLVIRYEGPRGGPGMREMLSTTAALYGQGMGDKVALITDGRFSGATRGFCVGHVGPEAAVGGPIGLLRDGDVITLDAIQGTLSVALSDAELAERRKAWTARPNTATSGYLWKYAQGVGPALYGAVTHPGGAKETQSYADV

SEQ ID NO: 408 - DNA, 1731 bp, Methylobacterium radiotolerans
atggtgacgcgtttgaacgacaagtcgaagctgccgagccgccacgtcacggaggggcccgaccgcgccccgcaccgctcctacctctacgccatgggcctgacccgcgagcagatccaccagccgctggtgggtgtcgcctcgtgctggaacgaggccgcgccctgcaacatctcgctgatgcgccaggcgcaggcggtgaagaagggcgtcgccgccgccaacgggacgccgcgcgagttctgcacgatcaccgtcaccgacggcatcgccatgggccacggcggcatgcgcgcgtcgctgccgtcgcgggaggttatcgccgactcggtcgagctgaccatgcgcggccacgcctacgacgccctcgtgggtctggcgggctgcgacaagtcgctgcccggcatgatgatggcgatggtccgcctgaacgtgccctcgatcttcatctacggcggctcgatcctgccgggctcgttccgtggcaagcccgtgaccgttcaggacctgttcgaggcggtcggcaaggtggccgtcggcgacatgagcctcgaggatctcgacgagctggagcaggtcgcctgcccgtcggccggcgcctgcggcgcgcagttcaccgccaacaccatggcgaccgtctccgaggcgatcggcctggcgctgccgtactcggccggcgccccggccccctacgagatccgcgacaagttctgcgcgaccgccggcgagaaggtgatggagcttctggagaagcgcatccgcccgcgcgacatcgtcacccgcaaggccctggagaacgccgccacggtggtggcggcctcgggcggctcgaccaacgcggcgctgcacctgccggcgatcgcgcacgagtgcggcatcgagttcacgctgttcgacgtggccgagatcttccggcgcacgccctacatcgccgacctgaagcccggcgggcgctatgtcgccaaggacatgttcgaggtcggcggcatcccgctgctgatgaagacgctcctcgaccacggcttcatgcacggcgactgcatgacggtcaccggccgcaccatcgcggagaacatggaccgggtgacctggaacccggaccaggacgtggtctacccggccaaccgcccgatcaccccgaccggcggcgtcgtcggcctcaagggcaacctcgcccccgagggcgcgatcgtgaaggtcgccggcatcccggccgagaagcaggtcttcaccggcccggcccgcgtgttcgacggcgaggaggcctgcttcgcggccgtgcaggcgcgcagctacaaggaaggcgacgtcctcgtgatccgctacgagggtccgcggggcggccccggcatgcgcgagatgctgtcgaccaccgcggccctctacggccagggcatgggcgacaaggtcgcgctgatcaccgacgggcgcttctcgggcgcgacccggggcttctgcgtcggccatgtcggccccgaggccgccgtgggcggcccgatcgggctgctccgcgacggcgacgtgatcaccctcgacgcgatccagggcacgctcagcgtcgccctgtccgacgcggaactggccgagcgccgcaaggcctggaccgcgcggcccaacaccgcgacctccggctacctctggaaatacgcgcagggcgtcggcccggccctgtacggcgccgtcacccatccgggaggtgccaaggagacgcagagctatgcggacgtctag

SEQ ID NO: 409 - protein, 560 aa, Leptothrix cholodnii
MSFNRRSKNITEGVARAPNRSMYYALGYQQDDFSKPMIGVANGHSTITPCNSGLQKLADAAVIGIKEAGGNPQIFGTPTISDGMAMGTEGMKYSLVSREVIADCVETCVGGQWMDGVIVIGGCDKNMPGGMMGMLRANVPALYVYGGTILPGKYKGQDLNIVSVFEAVGQFSAGKMAEEDFCEIERRAIPGSGSCGGMYTANTMSSSFEALGMSLPYSSTMANVEEEIVASVKVAAGVLVEAVKADLKPRDIVTKKAIENAVAVIMATGGSTNAVLHFLAIAHAAEVEWTIDDFERVRRRTPVLCDLKPSGKYLAIDLHHAGGIPAVMKELLKHGLLHGDCMTITGKTVAENLADVPDLRADQDVIRAVTNPIYAEGHLAILKGNLSPEGCVAKITGLKSPVMTGPARVFEDEQSALAAIMANKIVAGDVMVLRYLGPKGGPGMPEMLAPTGALIGQGLGESVGLITDGRFSGGTWGMVVGHVAPEAYAGGNIALVQEGDSITIDAHQLLLQLNVSDDELARRRAAWTAPAPRYTRGVLAKFAFNASSASAGAVLDKFGG

SEQ ID NO: 410 - DNA, 1683 bp, Leptothrix cholodnii
atgagcttcaaccgccgctccaagaacatcaccgaaggcgtcgcgcgcgccccgaaccgctcgatgtactacgcgctgggctaccagcaggacgacttcagcaagccgatgatcggcgtggccaacggtcactcgaccatcacgccgtgcaactcgggcctgcagaagctggccgacgccgcggtgatcggcatcaaggaagccggcggcaacccgcagatcttcggcacgccgacgatttcagacggcatggcgatgggcaccgagggcatgaagtactcgctggtgtcgcgcgaggtgatcgccgactgcgtcgagacctgcgtgggcggccagtggatggacggcgtgatcgtcatcggcggctgtgacaagaacatgcccggcggcatgatgggcatgctgcgcgccaacgtgccggcgctgtacgtctacggcggcaccatcctgccgggcaagtacaagggccaggacctcaacatcgtcagcgtgttcgaggccgtgggccagttctcggccggcaagatggccgaagaggatttctgcgagatcgagcgccgcgccatccccggctcgggttcatgcggcggcatgtacaccgccaacacgatgagttcgtcgttcgaggcgctgggcatgagcctgccgtactcgtcgacgatggccaacgtggaggaagagatcgtcgccagcgtcaaggtggcggccggcgtgctggtcgaggcggtcaaggccgacctgaagccgcgcgacatcgtcaccaagaaagcgatcgagaacgccgtcgccgtgatcatggccaccggcggctcgaccaacgcggtgctgcatttcctggcgatcgcccacgccgccgaagtcgagtggacgatcgacgacttcgagcgcgtgcgccgccgcacccccgtgctgtgcgacctgaagcccagcggcaagtacctggcgatcgacctgcatcacgccggcggcatcccggcggtgatgaaggaactgctcaagcacggcctgctgcacggcgactgcatgaccatcaccggcaagaccgtggctgaaaacctggccgacgtgcccgacctgcgcgccgaccaggacgtgatccgcgcggtcacgaacccgatctacgccgaaggccacctggcgatcctgaaaggcaacctcagccccgaaggctgcgtcgccaagatcaccggcctgaagagcccggtcatgaccggcccggcacgcgtgttcgaggacgaacaatcggcactcgccgcgatcatggccaacaagatcgtcgccggtgacgtgatggtgctgcgctacctcggccccaagggcggcccgggcatgcccgagatgctggcgcccaccggcgcgctgatcggccagggcctgggcgagagcgtcggcctgatcaccgacgggcgtttttcgggcggcacctggggcatggtggtcggccacgtcgcgcccgaggcctatgcgggcggcaacatcgcgctggtgcaggagggtgactcgatcaccatcgacgcccaccagctgctgctgcagctcaacgtcagcgacgacgaactggcccgccgccgcgccgcctggacggcgccggcgccgcgctacacccgcggcgtgctggcgaagttcgcgttcaacgcttcgagcgcgagcgccggtgcggtgctcgacaagttcggcggctga

SEQ ID NO: 411 - protein, 580 aa, Verrucomicrobium spinosum
MPPKSSAKSKAKSAASSELHRKHSAIVVDGVERAASRAMLHAVGFKRDDFKKSVIGIASTWSMVTPCNMHIDRLAKEAAKGADAAGGKSIIFNTITISDGISMGTEGMKYSLVSREVIADSIETVVGCEGMDGFVAIGGCDKNMPGCVIAMARLNRPSVFVYGGTILPGCVGPEKKESDIVTVFEAVGKHANCLIGDKELEDIEEHAIPGEGSCGGMYTANTMASAIEAMGLSLPNSGAQSAVSDDKLRDCFDAGAAVLNMIKLGITPRDIITKESFENAITLIITLGGSTNAVLHLIAMAHSAGVKLSIEDFVRIGKKTPVLADLKPSGKYFMNDLVKIGGTVPLMKILVEEGLMHGDCLTVTGRTMKENLSKIKLIYPKSQNIIYPLSNPIKKDSHLVIFKGNLCPEGAVGKISGKEGLVFNGKAIVFESEEKALDAILNDKVKKGHVIVIRMEGPKGGPGMREMLSPTSAIMGKGLGKDVALITDGRFSGGSHGFVVGHVTPEAFVGGPIAVIKNGDPITIDAEKRAITLGIPAKELQARLKAWKQPKPRYTRGVLAKYAATVTSASEGAVTDKDVV

SEQ ID NO: 412 - DNA, 1743 bp, Verrucomicrobium spinosum
atgcctcccaaatcgtccgcgaaatcgaaagcgaagtccgccgcctcctctgaactgcatcgcaagcactccgccatcgtcgtggacggcgtggagcgcgccgccagccgcgccatgctgcacgccgtgggcttcaagcgggacgactttaagaagtcggtcatcggcatcgcctccacctggagcatggtcaccccgtgcaacatgcacatcgaccgcctggccaaagaggccgccaagggcgctgacgccgccgggggcaagagcatcatcttcaacaccatcaccatctccgacggcatctccatgggcacggaggggatgaaatactccctcgtgagccgcgaggtcatcgccgactccatcgagaccgtggtgggctgcgagggcatggacggcttcgtcgccatcggcggctgcgacaaaaacatgcccggctgcgtgatcgccatggcccggctcaaccgccccagcgtcttcgtttacggcggcaccatcctccccggctgcgtgggccccgagaagaaggaaagcgacatcgtcaccgtgttcgaggccgtgggcaagcacgccaactgcctcatcggcgacaaggagctggaagacatcgaagagcacgccatccccggggaaggctcctgtggcgggatgtacacggcgaacaccatggccagcgccatcgaggccatgggcctgagcctgcccaacagcggcgcgcaatccgccgtgtccgacgacaagctgcgcgactgtttcgacgccggcgctgccgtgctgaacatgatcaagctgggcatcaccccgcgtgacatcatcaccaaggagtcgtttgaaaacgccatcaccctcatcatcaccctgggcggctccaccaacgccgtgctgcacctcatcgccatggcccactccgccggcgtgaagctcagcattgaggacttcgtccgcatcggcaagaagaccccggtcctggccgacctcaagcccagcggcaagtacttcatgaacgacctcgtgaagatcggcggcaccgtgccgctcatgaagatcctcgtggaagaaggcctcatgcacggcgactgcctcaccgtcaccggccgcacgatgaaggagaacctcagcaagatcaaactgatctaccccaagagccagaacatcatctacccgctgagcaacccgatcaaaaaagacagccacctggtcatctttaaagggaacctctgccctgagggtgccgtcggcaagatcagcggcaaggaaggcctcgtcttcaacggcaaagccatcgtgttcgagtccgaggagaaggcgctggacgccatcctcaatgacaaggtgaaaaaaggccacgtcatcgtcatccgcatggaaggaccgaagggcggccccggcatgcgcgagatgctgagccccaccagtgccatcatgggcaagggcctgggcaaagacgtcgccctcatcaccgacggccgtttcagcggcggcagccacggcttcgtggtcggccacgtcaccccggaggccttcgtgggcggtccgattgccgtcatcaagaacggcgaccccatcaccatcgacgccgaaaaacgcgccatcaccctgggcattcccgccaaggaactgcaagcccgcctcaaagcctggaagcagcccaagccccgctacacccgtggcgtgctggccaagtacgccgccaccgtcaccagcgccagcgaaggcgcggtcacggacaaggacgtggtgtaa

SEQ ID NO: 413 - protein, 561 aa, Cyanothece sp.
MSENLRSRAVTQGSQRTPNRAMLRAVGFGDDDFNKPIVGVANGFSTITPCNMGINDLAKRAEAGIKSAGGMPQMFGTITISDGISMGTEGMKYSLVSRDVIADSIETACNGQSMDGVIAIGGCDKNMPGAMIAMARMNIPAIFVYGGTIKPGHYNGEDLTVVSAFEAVGQHSAGKIDDNTLLAIERNACPGAGSCGGMFTANTMSSAFEVMGMSLPYSSTMAAEDAEKADSTEKSAFVLVNAIRNQILPRQILTRKAFENAVSVIMAVGGSTNAVLHLLAIANTIGVDLTLDDFETIRQRVPVLCDLKPSGRYVTVNLHQAGGIPQVMKMLLNHGLLHGDALTISGQTIAEILADVPDEPPANQDVIRSWDNPVYKEGHLAILKGNLASEGAVAKISGVKNPQITGPARVFESEEECLEAILAGKINAGDVIIVRYEGPRGGPGMREMLAPTSAIIGAGLGDSVGLITDGRFSGGTYGLVVGHVAPEAYVGGTIGLVEEGDSITIDAKKKLLQVNVSEEELSQRRANWKAPEPRYQRGVLGKYAKLVSSSSLGAVTDLNLF

SEQ ID NO: 414 - DNA, 1686 bp, Cyanothece sp.
atgtctgaaaatttaagaagccgtgctgttacccaaggaagtcaaagaactcctaaccgtgccatgttgagggctgtcggcttcggagacgatgactttaataagcctattgttggggtagcgaatggcttcagtaccattaccccttgtaacatggggattaatgacttagccaaacgggctgaagcagggattaaaagtgcgggcggtatgcctcaaatgttcggtacgattactatcagtgatggtatttctatgggaacagaaggcatgaaatattccctagtgtcacgggatgtcattgccgactccattgaaaccgcttgtaatggtcaaagcatggatggggtgatcgctattggtggatgtgataagaatatgccaggggcgatgatagccatggcaaggatgaatatacctgctatttttgtctatggaggaactattaaacccggtcattacaacggggaagatttaacggtggttagtgcctttgaagcggttggccaacatagcgctggtaagattgatgataacacactactagccattgaacgcaacgcctgtcctggtgccgggtcctgtggaggaatgttcaccgccaataccatgtcttcggcttttgaagtgatgggtatgagtttgccctactcgtctacaatggctgcagaagatgcagaaaaagcagatagtaccgaaaagtcagcctttgtattagtaaatgccattcgtaatcagattttacctcgtcaaattttaacccgaaaagcttttgaaaatgccgtttctgtcatcatggctgtggggggatctaccaatgcagtgttacaccttttagccatagccaataccataggagttgacctcaccttagacgattttgaaaccatccgtcaacgggttcccgtcttgtgtgatttaaaaccatcgggacggtatgttaccgttaatttgcatcaagctggtggtattcctcaagtaatgaaaatgttattaaatcatggattattacatggggatgcgttgacgatttccggtcaaactatagcagaaattctagccgatgtaccggatgaaccccctgctaatcaagatgtcattcgttcctgggataaccctgtttataaagagggacatctagccattttaaaaggtaatttagcctctgaaggcgcagttgctaaaattagtggggtgaagaatcctcaaataacaggtccggcacgagtttttgagtcagaagaggaatgtctagaggcaattttagcaggaaaaattaacgcaggagatgtgattattgtccgctacgaaggtcctagaggcggtccaggaatgcgcgaaatgttagcaccaacctctgctattattggtgccggtttaggtgattctgtgggcttaattaccgatggacgtttttctgggggaacctatggtttagtcgtgggtcacgttgccccagaagcttatgttgggggaactatcggcttagtcgaagagggtgatagtattaccattgatgctaaaaaaaagctgctgcaagtgaatgtttcagaagaagaattaagccaacgtcgggctaactggaaagcccctgaacctcgttatcaaagaggggtattagggaagtatgctaagttagtttcttctagtagtttaggggcagttactgacttgaatttgttttaa

SEQ ID NO: 415 - protein, 574 aa, Opitutus terrae
MSSQPNPTTPRPHSSVVVDGHDRAPARSMLRAVGFTDEDFRKPQIAVASSPSDMTPCNVHLGELSEHARKGIVAAGGKPVYFNTITVTDGISMGTQGMRYSLVSREVIADSIETAVAAEGFDGLIAIGGCDKNMPGSMIAIARLNRPAVFIYGGTILPGFLPGDCEHQKPLDIVSVFEAVGKHAKGELDDAGLKQVESCAIPGPGSCGGMYTANTMASAIEALGMSLPNSSAQLAVGEAKRLDCERAGAAVMAMLKSGLRPRDIMTRQAFENAIMVCTALGGSTNLILHLLAIAHSAQVPLTLEDFKVIGERVPLLADLKPFGKYNMSHLVRIGGIRPMMKLLLDRGLLHGECLTVTGETIAETLKDVKPYGAYPNEQDIIRPWDQPIKKETHLRVLRGNLAPEGAIGKITGKEGLYFKGTAKVYEGEEDALQGILRGDVVKGDVVVIRNEGPVGGPGMREMLSPTSAVAGRGLIKDVALITDGRFSGGSHGFDVGHITPEAACGGPIGIVRNGDLIEVDAVKNTISLLISEPDYQARMKANKPRPPRETRGVLAKYAKLVSTASEGAVTDKYL

SEQ ID NO: 416 - DNA, 1725 bp, Opitutus terrae
atgagttcccagcctaatccaacgactccccgcccgcattcctcagtggtggtggacggccacgaccgcgcccccgcccgctcgatgcttcgagccgtcggtttcaccgacgaggactttcgcaaaccgcagatcgccgtcgcgtcgtcgcccagcgacatgacgccgtgcaacgtgcacctcggcgaactgagcgagcacgcgcgcaagggtatcgtcgccgccggcggcaagccggtctacttcaacaccatcacggtgaccgacggcatcagcatgggcacgcagggcatgcgctacagcctggtgtctcgcgaagtgatcgccgactccatcgaaaccgcggtggcggccgaaggcttcgacgggttgatcgcgatcggcggctgcgacaaaaacatgccgggctcgatgatcgccatcgcccggctcaaccgccccgcggtgttcatttacggcggcacgattctccccgggttcctgcccggcgactgcgagcaccaaaaaccgctcgacatcgtctcggtgttcgaagccgtcggcaagcacgccaagggcgaactcgacgacgccgggctgaagcaggtggaatcgtgcgcgatccccggtcccggctcctgcggcggcatgtataccgccaacaccatggccagcgccatcgaggcgctcggcatgagcctgcccaacagcagtgcgcagctcgccgtgggcgaagcgaagcggctcgattgcgagcgcgccggtgccgcggtcatggcaatgctcaagagcgggctgcggccgcgcgacatcatgacgcgccaagccttcgagaacgcgatcatggtctgcaccgcgctcggcggttcaaccaacctcattctccacctgctcgccatcgcgcacagcgcccaggtgccgctcacgctcgaggacttcaaggtcatcggtgaacgcgttccgttgctcgccgacctgaaaccgttcggcaaatacaacatgagccatctcgtccggatcggcggcatccggccgatgatgaagctgctgctcgatcgcgggctgctccacggcgagtgcctcaccgtcacgggcgagaccatcgccgaaacgctgaaggacgtgaagccctacggcgcttatccgaacgagcaggacatcatccggccgtgggaccagccgatcaaaaaggaaacgcaccttcgcgtgctccgcggcaatctcgcccccgagggcgcgatcggcaaaatcaccggcaaggaggggctttacttcaagggcaccgcgaaggtctacgagggcgaggaggacgcgctgcagggcattctccgtggcgacgtggtcaagggcgacgtggtcgtcatccgcaacgagggcccggtcggcggccccggcatgcgcgagatgctctcgcccaccagcgcggtcgccggtcgcgggctcatcaaggacgtcgcgctcatcaccgacggccggttctccggcggcagccacggtttcgacgtcggccacatcacgccggaagcggcctgcggcggtccgatcggcatcgtgcgcaacggcgatctcatcgaggtcgacgcggtgaagaacacgatcagcctgctgatttccgagccggactaccaggcccgcatgaaggccaataaaccgcggccgccccgcgagacccgcggcgtgctcgccaaatacgccaagctcgtcagcaccgcctccgagggcgccgtgacggacaagtatctttga

SEQ ID NO: 417 - protein, 558 aa, Leptospira biflexa
MSLNRYSRVLTQDESLPASQAMIIGSGVPYEDLNKPFVGIGSTGFDGNPCNMHLTTLAALQKKSVLDTKQMVGLLFNTIGVSDGITNGNDGMRYSLPSREIIADSIETISGAHFYDGIIFTAGCDKNMPGAIMAMARLNRPAIMVYGGTINGGHFKGEKLNIVSAFEAYGKKINGKISEEDFKEVIKNSCPGPGACGGMYTANTMATAIEVMGMSLPYSSSSPARSEEKKKECQEIGKYMYNLLEKDIKPSDIITPKSILNALRVITILGGSTNAALHMIAIARTMGIDLDLDQIQKVTDTTPLLADMKPSGKYLMEDLFAIGGTPAIMKFMLNEGMLDGSCLTVTGKTIAENLESLPDLPKDQDLLRPVSNPIKKEGHIQVLYGNIAKKGAVAKITGHEGEMFEGKAICFDSEVAANEGIRDGKVKPGHVVVIRYVGPKGGPGMPEMLKPTSAIIGAGLGDNVALITDGRFSGGSHGFVVGHITPEAMEGGEIALVEDGDVISINARTNTLDVKVSAEDLEKRRKKWKKPPYRVTSGYLWKYIQMVKDASTGCLTDR

SEQ ID NO: 418 - DNA, 1677 bp, Leptospira biflexa
atgagtttgaatcgatacagccgtgttttaacccaagacgaatctctccctgcatcccaagcaatgatcattggttcaggagttccttacgaagatttgaacaaaccttttgtcggaataggtagtacaggttttgacggaaatccttgtaacatgcatttgacaacccttgctgctttacaaaagaaaagtgtccttgatacaaaacaaatggttggacttttgtttaacaccatcggtgtgagcgatggaatcacgaatggaaatgatggaatgcgttattcccttccgtcacgtgagatcattgctgattcgattgaaacgatctcaggtgctcatttttatgacggaattattttcactgctggatgtgataaaaatatgccaggtgctattatggcgatggcaagactcaaccgtcccgccatcatggtgtatggcggaaccatcaatggtggccacttcaaaggagaaaaattaaatattgtttctgccttcgaagcatatggaaaaaaaattaacggaaaaatttcagaagaagatttcaaagaagtgatcaaaaactcctgcccaggtcctggtgcgtgcggtggaatgtacactgcaaatacaatggcaacagcgatcgaagtgatggggatgagtttgccatatagttcttcctcaccggcacgcagtgaagaaaaaaagaaagaatgccaagaaattggaaagtacatgtacaatcttttagaaaaagacatcaaaccttctgatatcatcactcctaaatccatcttaaatgcactccgtgtcatcacaatccttggtggatcaacgaatgcagcactccatatgatagccatcgcaaggacaatgggaattgatttagacctcgatcaaatccaaaaggtaacggatacaacaccattacttgccgacatgaaaccaagtggaaagtatttgatggaagatctttttgccattggtggaacacctgccatcatgaaatttatgttaaatgaaggtatgttagatggttcctgtttaactgtcactggaaaaaccatcgcagagaatttagaatctctaccggaccttcccaaagaccaagacttacttagacctgtcagtaacccgatcaaaaaagaaggtcatatacaagtgttatatggtaatatcgccaaaaaaggtgcagtggcaaaaatcactgggcatgaaggcgaaatgtttgaaggcaaagccatttgttttgattctgaagtcgcagcaaacgaagggattcgggatggaaaagtgaaacctggccatgttgttgtcattcgttatgtgggtccaaaagggggaccagggatgccagagatgttaaaaccaacttctgccatcattggagctggccttggtgacaatgttgctctcatcactgatggaaggttctctggtggaagccatggatttgtagtgggtcatatcactccagaagccatggaaggtggagaaattgctctcgttgaagatggggatgtaatttcgatcaatgcacgcacaaatacactcgatgtcaaagtcagcgctgaagatctggagaaacgacgtaaaaaatggaaaaaacctccttaccgagtgacaagcggttacctatggaagtacatccaaatggtaaaagatgcaagtacaggttgtttgacagaccggtaa

SEQ ID NO: 419 - protein, 578 aa, Methylacidiphilum infernorum
MNNDPSLFRLKEESSRQNKKSLHRAYSSKVFDGFIRSPNRSMLYPLGFSSTDLSQKDLIGIASTWSQVTPCNMHIDKLAREAAFGSCEAGAKALIFNTITISDGISMGTPGMKYSLVSREVIADSIETVVCCEGMDGIVALGGCDKNMPGCLIAMARLNRPAVFVYGGTILAGCYGGRQLDIVSVFEAVGSYAEGKISEEELKAIEQHAIPGPGSCGGMYTANTMACAIEALGMSLPNSSTHPAVSLDKIEDARNAGKAVLRLIDQGIRPRDILTKKAFENAITVVIALGGSTNAILHLLAIAHAAEVDLRLEDFDRIGRKVPVLADLKPSGKHSVADLSQVGGLAPLMKRLLEEGLLHGDSLTVTGETLAQNLASVADYPPSQTIVRPFSDPIKKESHLVILRGNLAPDGAVAKITGREGEKFSGVARPFDSEEEALEKILDGTIKKGDVVVIRYEGPKGGPGMREMLAPTAAIMGRGLGKDVALITDGRFSGGTHGFVVGHICPEAAVGGPLAVVEEGDTITIDAQNKEITLHVSPDVLQSRLSRWTPPPLKVKGVLYKFAKTVSQANLGAVTDLF

SEQ ID NO: 420 - DNA, 1737 bp, Methylacidiphilum infernorum
atgaacaacgatccctctctttttcgtctcaaagaagaatcaagccgacaaaataaaaaaagcctgcacagggcctattcctccaaggtattcgacggctttatccgctcccccaaccggtccatgctttatccccttggtttttcttcgaccgatctctctcaaaaagaccttatcgggatagcttcgacctggagccaggttaccccctgtaacatgcatatcgataagcttgcccgggaagccgctttcggtagctgcgaggccggggccaaggctctcatatttaacacgattacgatttcagatgggatatcgatgggcaccccggggatgaaatattccctcgtatccagggaggtcattgccgattccattgaaacggtggtttgttgcgaagggatggatgggatcgtggcccttgggggatgcgataaaaacatgcccggttgtctcatcgccatggcccggttaaataggcctgcggtatttgtttacgggggaacgatccttgccggttgttatgggggcaggcaactcgacatcgtttcggtatttgaagcggtcggatcctatgccgaaggcaagatcagcgaggaagaactcaaggcgattgaacagcatgccatccccggacccggatcctgcgggggcatgtatacggccaataccatggcttgcgccatcgaagccctcggcatgtctcttcccaacagttccacccatcccgccgtttccctcgataaaatcgaagatgcccgcaatgcaggcaaagcggtgcttcgactcatcgaccagggtattaggccaagggatattttgaccaaaaaagcctttgaaaacgccatcacggtggtcatcgccctgggaggatcgaccaacgcgatccttcatctcttagccatcgcccatgccgccgaagtggacctccggcttgaagacttcgaccgcatcggccgaaaagtccccgtgctggccgatctcaagccctcggggaagcactccgttgccgatctttcccaggttggagggttggctcctcttatgaaaaggctgttggaagagggccttttgcacggggactcgcttacggttacaggggaaacgttggcccaaaacttggcttccgttgccgattaccctccctcgcaaacgattgttcgacccttttccgatccgataaaaaaagagagtcatttggtcattctccggggcaacctcgcccccgacggagccgtggccaagataacgggaagggaaggagaaaaattcagcggtgtagcccgtccgtttgattccgaggaggaggccttggaaaagatcctcgatgggaccattaaaaagggagacgtggttgttatccgctacgaaggacccaagggggggccgggaatgcgcgagatgctcgctcccacggcagccatcatgggaagggggttaggcaaagatgtcgcgctgattaccgatgggaggttttctggaggtacacacggttttgtcgtcgggcatatttgtcccgaggccgccgttggcgggcccttggccgtcgtcgaagagggcgatacaatcaccatcgacgcccaaaacaaggaaattaccctgcatgtcagtcccgatgttcttcaaagccggctgtcccggtggacacccccgcccctcaaggtcaaaggggtgttgtacaagttcgccaagacggtaagccaagccaacctgggggcggtgaccgatcttttttga

SEQ ID NO: 421 - protein, 557 aa, Cupriavidus taiwanensis
MAFNKRSRHITQGVARSPNRSMYYALGYQKEDFDKPMVGIANGHSTITPCNAGLQRLADSAIDAIRAAGANPQVFGTPTISDGMSMGTEGMKYSLISREVIADCIETAAQGQWMDGVVVIGGCDKNMPGGMIALARTNVPGIYVYGGTIKPGHWKGKDLTIVSSFEAVGEFTAGRMSEEDFEGVERNACPSTGSCGGMYTANTMSSSFEALGMSLLYSSTMANPDQEKVDSAAESARVLVEAVKRDLKPRDIITRRSIENAVALIMATGGSTNAVLHYLAIAHAAEVEWTIDDFERIRRKVPVLCNLKPSGQYVATDLHRAGGIPQVMKILLKAGLLHGDCITITGRTLAEELEHVPDAPRADQDVILPIERALYAEGHLAILKGNLAEEGAVAKITGLKNPVITGPARVFEDEQSAMDAILADRINPGDILVLRYLGPKGGPGMPEMLAPTSAIIGKGLGESVGFITDGRFSGGTWGMVVGHVAPEAYVGGTIALVREGDSITIDAHKLLLQLNVSEQELAKRRADWKAPAPRYTRGVLAKFARLASTASKGAVTD

SEQ ID NO: 422 - DNA, 1674 bp, Cupriavidus taiwanensis
atggcattcaacaagcgctcccggcacatcacgcaaggcgtggcgcgctcccccaaccgctcgatgtactacgcgctcggctaccagaaggaggacttcgacaagccgatggtgggcatcgccaacggccattcgaccatcacgccgtgcaacgccggcctgcagcgcctggccgactcggccatcgacgcgatccgcgccgccggcgcgaacccgcaagtgttcggcaccccgaccatctccgacggcatgtcgatgggcaccgagggcatgaagtactcgctgatctcgcgcgaggtcatcgccgactgcatcgagaccgcggcccagggccagtggatggacggcgtggtggtgatcggcggctgcgacaagaacatgccgggcggcatgatcgcgctggcgcgcacgaacgtgccgggcatctatgtctacggcggcaccatcaagcccggccactggaagggcaaggacctgaccatcgtgtcgtcgttcgaggccgtgggcgagttcaccgcggggcgcatgagcgaggaagacttcgagggggtggagcggaacgcctgcccgtccaccggctcgtgcggcggcatgtacaccgccaacaccatgagctcgtcgttcgaggcgctgggcatgtcgctgctgtactcgtcgaccatggccaatccggaccaggagaaggtcgacagcgccgccgaatcggcgcgcgtgctggtcgaggccgtcaagcgcgacctcaagccgcgcgacatcatcacgcgccgttcgatcgagaacgcggtggcgctgatcatggccacgggcggctccaccaacgcggtactgcattacctggcgatcgcgcacgccgccgaagtggaatggaccatcgacgacttcgagcgcatccgccgcaaggtgccggtactctgcaacctcaagccgtcgggccagtacgtggcgaccgacctgcaccgcgccggcggcatcccgcaggtgatgaagatcctgctcaaggccggcctgctgcacggcgactgcatcaccatcaccggccgcaccctggcagaggaactcgagcacgtgcccgacgccccgcgcgccgaccaggacgtgatcctgccgatcgagcgggcgctctacgccgagggccacctggccatcctcaagggcaacctcgccgaggagggcgcggtcgccaagatcaccggcctgaagaacccggtcatcaccggcccggcacgcgtgttcgaggacgagcagagcgcgatggacgcgatcctggcggaccgcatcaaccccggcgacatcctggtgctgcgctatctcggccccaagggcggccccggcatgccggagatgctggcgccgacctcggccatcatcggcaagggcctgggagagtcggtgggctttatcaccgacggccgcttttcgggcggcacctggggcatggtggtcgggcacgtcgcaccggaggcctacgtcggcggcaccattgcgctggtgcgggaaggggattcgatcaccatcgatgcgcacaagctgctgctgcagctaaatgtatcggagcaagagctggcaaagcgccgtgccgactggaaagcaccggcgccgcgctatacgcgtggggtgctggcgaagtttgcgcggctggcatcgacagcgagcaagggcgcggtgacggactga

SEQ ID NO: 423 - protein, 591 aa, Chthoniobacter flavus
MSTPAKAPSKKAASKNGASLHRVYSKHMVDGYERAASRAMLHAVGFAREDFKKSQIGIASTWSMVTPCNMHIDQLARQAEAGSNAAGGKAVIFGTITISDGISMGTEGMKYSLVSREVIADSIETVVGCEGFDGLVAIGGCDKNMPGCLIAMARLNRPSVFVYGGTILPGCITGVLAEKRLRKDRREQFAGKNLDIVSCFEAVGSYANHNMDDRELALVEEQAIPGAGSCGGMYTANTMASAIEALGMSLPNSSAQNAVSPAKAADARAAGGAVLDLIKAGIRPRDIMTKQAFENAITVVIALGGSTNAVLHLLAMAHAAGVDLKIDDFTRIGRKVPVLADLKPSGRYLMSELVGIGGQTPLMKMLLEEGLLHGDCLTVTGKTIAANLKRVKPYPKGQDIVRGFDNPIKKDSHLVVLYGNLAPEGAVAKISGKEGLSFSGKAIVFENEQDALTAILDGRVKKGHVIVIRHEGPVGGPGMREMLSPTSAVMGKGLGKDVALITDGRFSGGSHGFVVGHITPEAALGGPLAVVKNGDAITIDAVKHQLTLDIPKSDLDARLAKWKAPKPHYTRGVLAKYAKQVSTASKGAVTD

SEQ ID NO: 424 - DNA, 1776 bp, Chthoniobacter flavus
atgagcacccctgccaaagccccgtcgaaaaaagccgcttccaagaacggcgccagcctccaccgcgtctattccaaacacatggtcgatggctatgagcgcgcggccagccgggcgatgctgcacgcggtgggcttcgctcgcgaggatttcaagaagtcgcagatcggcatcgccagcacctggtcgatggtcacgccctgcaacatgcacatcgaccagcttgcccgtcaggccgaggccggctcgaacgccgccggcggcaaggccgtcatcttcggcacgatcacgatttccgacggcatttcgatgggcaccgagggcatgaaatactcgctcgtttcgcgtgaggtcatcgccgattccatcgagaccgtggtgggttgcgaaggcttcgacggcctcgtggcgatcggtggttgcgacaagaacatgcccggctgtctcatcgccatggcgcggttgaatcgcccgagcgtatttgtctatggcggcacgattttgccgggctgcatcaccggcgtgctcgccgagaagcggctgcgcaaggaccggcgcgaacagtttgccggcaagaatctcgacatcgtgagctgcttcgaagcagtcggttcctatgccaatcacaacatggacgaccgcgaactcgcgctcgtcgaggagcaggccatccccggcgccggctcctgcggcggcatgtataccgcgaataccatggccagcgcgatcgaggcgctcggcatgtccctgccgaacagctcggcgcagaacgccgtctcgccggccaaggccgccgacgcgcgcgcggcgggtggcgcggtgctcgacctcatcaaggccggcattcgtccgcgggacatcatgaccaagcaggcctttgaaaacgccatcaccgtggtcatcgctctcggtggttcgaccaatgccgtgttgcatctcctcgccatggcccacgcggccggcgtggacctgaagatcgacgactttacccgcatcggccgcaaggtgccggtgctggccgatctcaagccgagcggccgttacctcatgagcgaactcgtcggcatcggcggccagaccccgctcatgaagatgctgctcgaggaagggttgctccacggcgattgcctcaccgtgaccggcaagaccatcgccgcgaatctcaagcgcgtgaaaccctacccgaagggtcaggacatcgtgcgtggcttcgataacccgattaaaaaggacagccatctcgtggtcctctacggcaacctcgctcccgaaggtgcggtggcgaagatcagcggcaaggaaggcctctcttttagcgggaaggcgatcgttttcgaaaacgagcaggacgccctcacggcgatcctcgatggccgcgtgaagaagggtcacgtcatcgtgatccgccacgaggggccggtgggcggccccggcatgcgcgaaatgctttcgccgaccagcgccgtgatgggcaaggggctgggcaaggacgtggcgctcatcaccgacggtcgcttcagcggcggctcgcacggtttcgtggtcggccacatcacgccggaagcagccctcggtggcccgctcgccgtggtgaaaaatggcgacgccattacgatcgatgcggtcaagcaccagctcacgctcgatatcccgaagtccgatctcgacgcccgtctcgccaaatggaaagcccccaagccgcactacacccgtggcgtgctggcgaaatacgccaagcaggtcagcaccgccagcaagggcgccgttacggattaa

SEQ ID NO: 425 - protein, 561 aa, Cyanothece sp.
MSDNYRSRIITQGSQRTPNRAMLRAVGFGDNDFTKPIVGVANGYSTITPCNMGINDLALRAEAGLKQAGAMPQIFGTITVSDGISMGTEGMKYSLVSRDVIADSIETACNGQSMDGVLAIGGCDKNMPGAMIAIARMNIPAIFVYGGTIKPGKYNGQDLTVVSAFEAVGQHSAGKIDDAQLLGIERNACPGAGSCGGMFTANTMSSAFEVMGMSLPYSSTMAAEDAEKADSTEKSAFVLVDAIRKQILPSQILTRKAFENAISVIMAVGGSTNAVLHLLAIAHTIGVELSIDDFEAIRARVPVLCDLKPSGRYVIVDLHQAGGIPQVMKMLLVHDLLHGDALTITGQTVAEVLKDVPDEPPQGQDVIRPWNNPVYKEGHLAILKGNLATEGAVAKISGVKNPKITGPARVFESEESCLEAILAGKIQAGDVIIVRYEGPKGGPGMREMLAPTSAIIGAGLGDSVGLITDGRFSGGTYGLVVGHVAPEAAVGGNIALVQEGDSITIDAKERLLQLNVAEDELIRRRANWQPPIPRYTKGVLAKYAKLVSSSSIGAVTDKDLF

SEQ ID NO: 426 - DNA, 1686 bp, Cyanothece sp.
atgtcagataattacagaagtcgcatcattacacaaggcagtcaacgtacaccaaaccgggccatgcttcgggcggtaggttttggagataatgactttactaagcccattgtgggagtggctaacggatacagcaccattaccccttgtaatatgggcatcaatgatctcgcgctgcgggccgaagccggactcaagcaagcgggagccatgccgcaaattttcggcaccattaccgtgagtgacggaatttctatgggaacagaaggaatgaaatactccctcgtctcgcgcgatgtgatcgctgactctatcgaaaccgcttgtaacggtcaaagtatggatggtgtgcttgccattggcggctgtgataaaaatatgcccggggccatgatcgccatcgctcgtatgaatatccctgctatcttcgtctatggcggtaccattaaacccggaaaatacaacggacaagatttaaccgttgtcagtgcctttgaagccgtaggacaacatagtgccggtaaaatagatgatgctcaattattaggaatagaacggaatgcttgccccggggcgggttcctgtgggggaatgtttaccgctaacaccatgtcctccgcttttgaagtaatggggatgagcttaccttattcttccactatggcagcagaagatgcagaaaaagccgacagtaccgaaaaatccgcttttgtgctggtagatgccatcagaaagcaaattttgcccagtcagattttaacccgtaaagcctttgagaatgcgatttccgtgattatggccgttgggggatcgaccaacgcggttttacatttattagcgatcgctcataccataggggtagaactgagcatcgatgactttgaagccattagagctagagttcccgtactttgtgacctcaaaccgagtggacgctatgtcatcgttgatttacatcaggcggggggcattccccaagtgatgaaaatgcttctcgtccatgacttattacacggggatgctttaaccatcaccggtcaaacggttgcagaagttttaaaagacgtacccgatgaaccccctcaaggacaagatgtcattcgtccttggaataacccagtgtataaagaaggacacctagcgatcttaaaaggaaatttagccaccgagggagcagtcgctaaaattagcggggtcaaaaatcctaaaattaccggtccggcgcgagtatttgaatccgaggaaagctgtctagaggcgattcttgcaggtaaaattcaagctggcgatgtgattattgttcgttatgaagggcccaaaggtggccccggtatgagagaaatgttagccccgacttcagccattattggggcaggattgggagattccgtaggattaattactgatgggcgtttttctgggggaacttacgggctagtcgtcggtcatgttgccccagaagcagcagtaggcggaaatattgccctcgtacaagagggagatagcattaccattgatgcgaaagagcgattattacagcttaatgtagctgaagatgaattaatccgtcgtcgcgctaactggcaaccgcccatccctcgttataccaaaggtgtattagcgaaatatgccaaattagtctcttctagtagtataggagcggttaccgacaaagatttattctaa

SEQ ID NO: 427 - protein, 579 aa, Phenylobacterium zucineum
MHRKPDGSWDKSKLPSRHVTEGPSRAPHRSYFYAMGLGSREIAQPFVGVASCWNEAAPCNTALMRQAHAASEGVKRAGGTPREFCTITVTDGIAMGHEGMRSSLVSRDLIADSVELTMRGHAYDALIGVAGCDKSLPGMMMAMLRLNVPSAFIYGGSILPGTWHGREVTVQDVFEGVGKHSAGQMSLEDLCDLEQHACPGDGACGGQYTANTMACVSEAIGLALPLSSALPAAYLDRDEYARATGEAVMALLERNLRPRDICTREAFENAAVVVAATGGSTNGGLHLPAMAHECGIEFTLRDVCEIMKRTPYLADLMPGGRYPAKKMGEAGGVPMLLRTLLDAGLIHGDCMTVTGKTIRENLEGVVWNDEQDVIRPVSNPLSPTGGVVGLWGSLAPDGAIVKVAGLSHTKHRGPARVFDGEEACFAAVEARDYKEGDVLVIRYEGPKGGPGMREMLATTAAIKGQGVENIALITDGRFSGATRGLCVGHIGPEAADGGPIALVKDGDIISIDAEAGTIELEVDPIELEHRAHLLAQEEPRRTNYGSGAIWKYVQLVGPAHLGAVTHPGHAGETHVYADI

SEQ ID NO: 428 - DNA, 1740 bp, Phenylobacterium zucineum
atgcatcgcaaaccggacggatcctgggacaagtcgaagctccccagccgccacgtgaccgaggggccctcgcgggcgccgcaccggtcgtacttctatgcgatgggcctgggcagccgcgagatcgcccagccgttcgtgggcgtagcctcgtgctggaacgaggccgcgccgtgcaacaccgccctgatgcgccaggcgcacgccgcgtccgagggcgtgaagcgcgccggcggcaccccgcgcgagttctgcaccatcaccgtcaccgacgggatcgccatgggccacgagggcatgcgctcgtccctggtcagccgggacctgatcgccgactccgtcgagctgaccatgcgcggccacgcctacgacgccctgatcggcgtcgccggctgcgacaagagcctgccgggcatgatgatggccatgctgcgcctgaacgtgccctcggccttcatctacggcggctccatcctgcccgggacctggcacgggcgagaagtgaccgtgcaggacgttttcgagggcgtcggcaagcactccgccggccagatgagcctcgaggatctgtgcgacctcgagcagcacgcctgtccgggcgacggggcctgcggcggccagtacacggccaacaccatggcctgcgtgtccgaggcgatcggcctggccctgccgctgtcctcggcgctgccggcggcctatctcgaccgcgacgaatacgcccgcgccaccggcgaggcggtgatggccctgctggagcgcaacctgcgtccgcgcgatatctgcacccgcgaggcgttcgaaaacgccgccgtggtggtggccgcgaccggggggtcgaccaacggcggcctgcacctgccggccatggcccacgagtgcggcatcgagttcaccctgcgcgacgtgtgcgagatcatgaagcggacgccgtacctggccgacctgatgccgggcgggcgctatccggccaagaagatgggcgaggcgggcggcgtgccgatgctgctgcgcaccctgctggacgccggcctgatccacggcgactgcatgacggtcaccggcaagacgatccgcgagaacctggaaggcgtcgtctggaacgacgagcaggacgtcatccgcccggtctccaatccgctgtcgcccacgggcggcgtcgtcggcctgtggggctcgctggcccccgacggcgcgatcgtgaaggtggccggcctcagccacaccaagcaccgcggcccggcccgggtgttcgacggcgaggaggcctgcttcgccgccgtcgaggcgcgcgactacaaggaaggcgacgtgctggtcatccggtacgaggggcccaagggcggccccggcatgcgcgagatgctggccaccacggcggccatcaagggccagggcgtggagaacatcgcgctcatcaccgacggccggttctcgggcgccacgcgcggcctctgcgtcggccacatcggtccggaagccgcggacggcggccccatcgcgctggtgaaggacggcgacatcatctccatcgacgccgaggccggcacgatcgagctggaggtcgatccgatcgagctggagcaccgcgcccacctgctggcccaggaggagccccgccggacgaactacggctcgggcgcgatctggaagtacgtccagctcgtgggccccgcgcacctcggcgccgtgacccatccgggccacgctggcgagacgcacgtctacgcggacatctga

SEQ ID NO: 429 - protein, 557 aa, Leptospirillum sp.
MKKPFRSRAITEGVERSPNRAMLRAVGFQDGDFEKPIIGVANGYSTITPCNMGLNSLALRAEDALRQKGAMPQIFGTITVSDGISMGTEGMKFSLVSREVIADSIETAVNAQSMDGVIAIGGCDKNMPGALIAMGRMNIPSIFVYGGTIKPGHWEGQDLTVVSSFEAVGAYSAGKMDEATLTEIERHACPGAGSCGGMFTANTMSSAIEAMGMSLPYSSTMAAEDLEKAESAAESARVLVQAVLNDLRPRQILTRKAFENAIAVLMAVGGSTNAVLHLLAIARSVDVPLSIDDFEHIRRKVPVLCNLKPSGAYVATQLHAVGGIPLVMRMLLDKGLLHGDALTITGRTISETLRNVPSRPPAGQDVVLPFDKPVYREGHLAILKGNLAPEGSVAKISGIKHRSITGPARVFDSEESCMAAILAREIRPGDIVVIRYEGPKGGPGMREMLAPTSALIGEGLGDSVGLITDGRFSGGTYGMVVGHVSPEAAVGGPIGLVQEGDLITIDADRNLIEVKVSEEEMTRRQSLWKEPPLRYTKGIMAKYRLLVKSASEGAVTD

SEQ ID NO: 430 - DNA, 1674 bp, Leptospirillum sp.
atgaaaaagccatttcgaagccgggccatcacggaaggagtggaaaggtctcccaacagggccatgctccgcgccgtcggtttccaggatggggattttgaaaaaccgatcatcggagtggcgaatggttacagcaccattaccccctgcaacatggggttgaacagtctggcgcttcgcgccgaggatgcccttcgccagaaaggagccatgccccagatctttggaaccatcacggtttcggatggaatatcgatgggaacggagggaatgaagttttccctggtgtcccgggaagtcatcgccgactccatcgaaacggcggtcaacgcccaaagcatggacggcgtgatcgccatcggggggtgcgacaagaacatgccgggagccctgatcgccatggggcgcatgaacatcccctccatctttgtttatggaggaaccatcaagcccggacactgggaaggccaggacctgacagtcgtgagctcgtttgaagccgtcggggcctactcggcaggcaagatggatgaggcgaccctgaccgaaatcgaacgtcatgcctgtccgggagccggatcctgtggcggcatgttcaccgccaataccatgtcgtcggcgatcgaagccatggggatgagtttgccctattcctctaccatggcagcggaagaccttgaaaaagcggagagcgcggcggaatccgcaagagttcttgtccaggcggtcctgaacgacctgcgtccccgacagatcctgacccggaaggcctttgaaaacgccattgcagtcctgatggccgtcggaggttcgacaaacgcggttcttcacctcctcgcgatcgcccgctccgtcgacgtccccctttccatagacgactttgaacacattcgacggaaggtccctgtcctctgcaacctcaagccctccggggcctatgtcgccacacagcttcacgctgtcgggggcattcccctcgttatgcgcatgctgctggacaaagggctcctccatggcgacgcgctgaccattacaggacggacgatttccgagaccctccggaacgtcccctcccggcccccggccggacaggatgtcgttctccccttcgacaaacccgtttaccgggagggccatcttgcgatcctgaaggggaatctcgcccccgaaggatccgtcgcaaagatctcgggcatcaaacaccgttccatcaccggcccggcccgggtattcgactccgaagaaagctgcatggcagccatcctggcccgggagattcgtcccggagacattgtcgtgatccgttacgaaggccccaaaggcggtcccggcatgcgggaaatgctggccccgacctccgccctgatcggagaaggtctcggggactcggtcggcctgattacagacgggcgcttttccgggggaacatacggcatggtggtggggcacgtctcaccggaagcggctgtgggcgggccgatcggactggtgcaggaaggagacctcattacgattgacgccgaccggaatctgatcgaggtcaaggtttcggaagaggaaatgacgagaagacaatctctgtggaaggagccccctctccggtacacaaagggaatcatggccaaataccgtcttctcgtcaaaagtgccagcgaaggcgccgtgacagactga

SEQ ID NO: 431 - protein, 560 aa, Arthrospira maxima
MSDNLRSKAITQGNQRTPNRAMLRAVGFGDEDFNKPIVGIANGYSTITPCNMGLNDLALRAEAALRQSGTMPQLFGTITISDGISMGTEGMKYSLVSRDVIADSIETVCNGQSMDGVLAIGGCDKNMPGAMIAIARMNIPAIFVYGGTIKPGHYNGCDLTVVSAFEAVGQHSAGKIPDEELLGIERNACPGAGSCGGMFTANTMSSAFEAMGMSLMYSSTMAAEDAEKAESTEQSAFVLAEAIRKQILPSQILTRDAFENGMAVIMAVGGSTNAVLHLLAIASSMGVELTLDDFETMRQRVPVLCDLKPSGRFVTTEFHQAGGVPQVMKMLLEHGLLHGDALTITGKTIAEQLTDIPAEPDPNQEVIRPWDNPMYAQGHLAILKGNLASEGSVAKITGVKNPQITGPARVFESEEECLEAILAGSINPGDVIIVRYEGPKGGPGMREMLAPTSAIIGAGLGDSVGLITDGRFSGGTYGLVVGHVAPEAAVGGAIALVKEGDSITIDAKARLLQINISDEELQARREEWQPRQPRYTRGVLAKYAKLVSTSSRGAVTDVNL

SEQ ID NO: 432 - DNA, 1683 bp, Arthrospira maxima
atgtcagataatttgagaagtaaagcaattacccagggcaatcagcgaacccctaaccgggctatgttaagggctgtaggctttggcgatgaggatttcaataaacccattgtgggcattgctaatggttatagtaccattactccctgcaatatgggcttaaatgatttagcattacgggcagaagcggccctgagacaatcgggaactatgccccaactgtttggaaccattactatcagtgatggtatctctatgggtacggaggggatgaaatattccctagtgtcgcgggatgtaattgccgattccatagaaactgtctgtaatggtcagagtatggatggggtgttagctattggcggatgtgataaaaatatgcctggggcgatgattgccattgctcgcatgaatattccggcaattttcgtttacgggggaactatcaaaccgggtcactataatggctgtgacctcactgtggttagcgcctttgaagcggtgggacaacatagcgcggggaaaatccctgatgaggaattactggggattgaacgcaatgcttgtcctggggcgggttcctgtggtggtatgtttacggctaatactatgtcgtcagcttttgaggctatggggatgagtttgatgtactcttcgactatggcggctgaagatgcggagaaagcggaaagcactgaacaatcggcgtttgtattggctgaggcgattcggaaacagattttaccgagccaaattctcacccgtgatgcttttgaaaatggtatggcggtgattatggctgtggggggttctactaatgcggtgctacatttactggcgatcgccagttctatgggggtagaactaactctggatgattttgaaactatgcgacaacgggttccggtattgtgcgacctgaaacctagtggtcggtttgtaactacagaatttcaccaagctgggggagttccccaggtgatgaaaatgttgttggaacatggcttgttacatggcgatgctttgacgattactggtaaaactattgcggaacagttgactgatatcccggctgaacctgaccctaaccaggaggtgattcgcccttgggataatcctatgtatgctcaaggacatttggctattctcaagggtaatttggcttcggaggggtctgtggctaaaattactggggtcaaaaatcctcaaattactggaccggctagggtgtttgagtcggaggaggaatgtcttgaggcaattctggcgggttcaattaatccgggagatgtgattatcgtccgctatgaaggcccgaaaggggggccgggaatgcgggagatgctggctcctacttcggcgattattggggctggtttgggggattctgtggggctgattactgatggtcgcttctcagggggaacctatggtctggttgtgggtcatgtggctccagaggcggcggtcggaggtgcgatcgccttagtgaaggagggcgatagtattactattgatgctaaagcccgcctattacaaattaatatctctgatgaggaattacaggcgcgacgggaggaatggcagcctcgtcaacctcgctatacgaggggagtcctagctaagtatgctaagttggtatccactagcagtcgcggcgcggtcacggatgtaaatttgtaa

SEQ ID NO: 433 - protein, 574 aa, Oligotropha carboxidovorans
MDAKTNIKSRLPSRHVTEGPARAPHRSYLYAMGLTTEQIHQPFVGVATCWNEAAPCNISLMRQAQAVKKGVASAGGTPREFCTITVTDGIAMGHEGMRSSLPSREVIADSVELTIRGHSYDALIGLAGCDKSLPGMMMAMCRLNVPSIFIYGGSILPGNFRGQQITVQDMFEAVGKHSVGEMSDADLDEIERVACPSAGACGAQFTANTMATVSEAIGLALPYSAGAPAPYEIRDSFCAAAGEKVMELIARNIRPRDIVTRKALENAAAVVAASGGSTNAALHLPAIAHECGIEFDLFDVAEIFKKTPYVADLKPGGRYVAKDMFEAGGIPLLMKTLLDNGYLHGDCLTVTGRTIAENLQSVKWNPHQDVVRPADRPITATGGVVGMKGNLAPEGAIVKVAGMSVLKFTGPARVFDCEEDAFEAVEKRTYKEGDVLVIRYEGPRGGPGMREMLATTAALYGQGMGAKVALITDGRFSGATRGFCIGHVGPEAAIGGPIGLLRDGDIIELDAEAGTLNVRLSEAELAERRKVWKPRETGTGSGALWKYAQQVGPAVRGAVTHPGKAGEKSCYADI

SEQ ID NO: 434 - DNA, 1725 bp, Oligotropha carboxidovorans
atggacgccaagaccaacatcaagtcgagattgccgagccgccatgtcacggaaggcccggcccgcgctccgcaccgctcctatctctacgccatgggtctcaccaccgagcagatccatcagccgttcgtcggcgtggcgacctgctggaatgaggctgctccctgcaatatttcgctgatgcgccaggcgcaggccgtgaagaagggcgtcgcctcggcgggcggcaccccccgcgagttctgcaccatcaccgtcaccgacggcatcgccatgggccacgagggcatgcgctcctcgctgccgtcccgcgaggtgatcgcggattccgtcgaactcaccatccgcggccattcctatgacgccctgatcgggctcgccggctgcgacaagtccttgcccggtatgatgatggcgatgtgtcgcctcaacgtgccctcgatcttcatctatggcggctcgatcctgcccggcaatttccgcggccagcagatcaccgtgcaggatatgttcgaggcggtcggcaagcattcggtcggcgaaatgtccgacgccgacctcgacgaaatcgagcgcgtggcgtgtccctcggcgggcgcctgcggcgcgcagttcaccgccaacaccatggcgaccgtctccgaggcgatcgggcttgcgctgccgtattcggccggcgcgccagcgccttatgaaatccgcgactccttctgcgcggcggcgggcgagaaggtgatggagctgatcgccaggaacatccgtccgcgcgacatcgtcacccgcaaggcgctggaaaatgccgcggctgtggttgcggcctccggcggctcgaccaacgcggcgctgcatctgcctgcgattgcacatgaatgcgggatcgaattcgatctgttcgacgtcgccgaaatcttcaaaaagacgccttatgtcgcagatttgaagccgggtggccgttatgtggccaaagacatgttcgaagctggtggcattccgctgctgatgaagacgctgctggacaacggttatctgcacggcgactgcctgacagtgacgggccgtaccattgccgagaacctccagagcgtgaaatggaacccgcaccaggatgtggtgcgtccggcggatcggccgatcacggcgaccggcggcgtcgtgggcatgaagggcaacctcgcgccggagggcgcgatcgtgaaggtggctggcatgtccgtcctgaagttcacgggccccgcgcgcgtgttcgactgcgaggaagacgcgttcgaggccgtggaaaaacgcacctacaaggaaggcgacgttctcgtgatccgctacgagggccccaggggcggcccgggcatgcgcgagatgctcgccaccactgctgctctttatggccagggcatgggcgcgaaggttgcgcttatcaccgacgggcgcttctccggcgccacgcgcggcttctgcatcggccatgtcggcccggaagcggcgatcggcggcccgattggccttctccgggacggagacatcatcgaacttgatgccgaagccggcacgctcaatgtcaggctgagcgaggccgaactggccgagcggcgcaaggtgtggaaaccgcgcgagacgggcactggctccggtgcgctctggaaatatgcccagcaggtcggccctgcggtcaggggagcggtgacgcaccccggcaaggcgggtgagaagagttgctatgcggatatttaa

SEQ ID NO: 435 - protein, 577 aa, Rhodospirillum centenum
MPTGPEKTWDKSKLPSRHVSVGPERAPHRSYYYAMGMTEQEIARPFVGVATCWNEAAPCNIALNRQAQAVKTGVKAEQGTPREFTTITVTDGIAMGHQGMKASLVSREVIADSVELTMRGHCYDALVGLAGCDKSLPGMMMAMVRLNVPSVFMYGGSILPGKFRGKDVTVQDVFEAVGAFSAGRMDEKDLHELECCACPGSGACGGQYTANTMACVSEAIGLALPGSAGAPAPYESRDAYAEASGRAVMKLVEMNLRPRDIVTRKALENAAVVVAASGGSTNAALHLPAIAHEAGIEFDLHDVAAVFRRTPYIADLKPGGRFVAKDLFEVGGVPVLMKALLDGGFLHGDCITVTGRTIAENLADVVFPTDQEVIRPTSAPLSPTGGVVGLRGNLAPQGAIVKVAGMKNLRFSGPARCFDREEDAFAAVERREYKEGEVIVIRYEGPRGGPGMREMLATTAALYGQGMGDKVALITDGRFSGATRGFCIGHVGPEAAVGGPIGLLRDGDVITIDATTGELSVALSDAELAERRKGWQPRRHDFQSGAIWKYAQTVGDAEKGAVTHPGGKAETHCFADI

SEQ ID NO: 436 - DNA, 1734 bp, Rhodospirillum centenum
atgcccaccggccccgagaagacctgggacaagtccaagctgccgagccggcatgtgtccgtcggtccggagcgtgcgccgcaccggtcctactactatgccatgggcatgacggagcaggagatcgcccggcccttcgtcggcgtggcgacctgctggaacgaggcggcgccctgcaacatcgcgttgaaccgtcaggcccaggcggtgaagaccggggtgaaggcggagcagggcaccccgcgcgagttcaccaccatcaccgtcaccgacggcatcgccatgggccaccagggcatgaaggcgtcgctggtcagccgcgaggtgatcgccgattcggtcgagctgaccatgcgcggccactgctacgacgcgctggtcgggcttgccggctgcgacaagagcctgccgggcatgatgatggcgatggtccggctgaacgtgcccagcgtcttcatgtatggcggttccatcctgccggggaagttccgcggcaaggacgtcaccgtacaggacgtgttcgaggcggtgggtgccttcagcgccggccggatggacgagaaggacctgcacgagctggaatgctgcgcctgtccggggtcgggcgcctgcggcggccagtacacggccaacaccatggcctgcgtctccgaggccatcgggctggccctgccgggttcggccggtgcgccggcgccgtatgagagccgcgatgcctatgccgaggcgtcgggccgggccgtgatgaagctggtggagatgaacctccgcccgcgcgacatcgtcacccgcaaggcgctggagaacgcggccgtcgtcgtcgcggccagcggcggctccaccaacgccgccctgcacctgccggccatcgcgcacgaggccggcatcgagttcgacctgcacgatgtggccgccgtgttccggcgcacgccctacatcgccgacctgaagccgggcggccgcttcgtcgccaaggacctgttcgaggtcggcggcgtgccggtgctgatgaaggcgctgctggacggcggcttcctgcacggcgactgcatcacggtgaccggccggaccattgccgagaatctggccgacgtggtcttccccacggaccaggaagtgatccggccgaccagcgcgccgctgtcacccacgggcggcgtggtcggactgcgcggcaacctcgccccgcagggcgccatcgtgaaggtcgcgggcatgaagaacctgcgcttctccggtccggcccgctgcttcgaccgcgaggaggatgccttcgccgcggtcgagcggcgcgagtacaaggagggggaggtcatcgtcatccgctatgaggggccccgcggcggccccggcatgcgggagatgctcgccaccaccgccgccctctacggccagggcatgggcgacaaggtcgccctgatcaccgacggtcggttctccggcgccacccgcggcttctgcatcggccatgtcgggccggaggcggccgtgggcggaccgatcgggctgctgcgcgacggcgacgtcatcaccatcgacgcgaccacgggcgagctgtcggtggccctctccgacgctgagctggccgagcggcgcaagggctggcagccgcgccggcacgactttcagtccggcgcgatctggaagtatgcgcagacggtgggcgacgcggagaagggggcggtgacgcatccgggcggcaaggcggagacgcactgcttcgccgacatctga

SEQ ID NO: 437 - protein, 561 aa, Cyanothece sp.
MSDNLRSRIVTQGSQRTPNRAMLRAVGFGDNDFIKPIVGVANGYSTITPCNMGLNDLALRAEAGLKSAGAMPQMFGTITISDGISMGTEGMKYSLVSREVIADSIETACNGQSMDGVIAIGGCDKNMPGAMIAIARMNIPAIFVYGGTIKPGHYQGEDLTVVSAFEAVGKYSAGKIDDNELLAIERNACPGAGSCGGMFTANTMSSAFEAMGMSLPYSSTMAAEDAEKADSTEQSAFVLVEAIRKQILPSQILTRKAFENAIAVIMAVGGSTNAVLHLLAIANTMGVELTIDDFETIRKKVPVLCDLKPSGRYVTVNLHQAGGIPQVMKMLLNHGLLHGDALTISGQTIAEVLQDIPDEPPANQDVIRPWNNPVYPEGHLAILKGNLAAEGAVAKISGVKKPKMTGPARVFESEEACLDAILAGKISAGDVVIVRYEGPKGGPGMREMLAPTSAIIGAGLGDSVGLITDGRFSGGTYGLVVGHVAPEAFVGGTIALVNEGDSVTIDAEKRLLQLNVSDEELATRRAHWTPPKPRYQRGILGKYAKLVSSSSLGAVTDVELF

SEQ ID NO: 438 - DNA, 1686 bp, Cyanothece sp.
atgtcagataaccttagaagtcgaattgttacccaaggaagtcaacgaaccccaaaccgggctatgctcagggctgtagggtttggagacaatgactttattaaaccaatcgttggtgtagctaatggatatagtaccattacgccctgtaatatgggactcaatgacctagctttgcgggccgaagcgggattaaaaagtgccggagccatgccacaaatgtttggtaccattaccattagtgatggtatctccatggggacagaaggaatgaaatattcccttgtctcacgggaagttatcgcagactccatcgaaaccgcttgtaatggtcaaagtatggatggagtcattgccattggagggtgtgataagaatatgccaggggctatgattgctatagcccgaatgaatatccctgctattttcgtctatgggggtacgattaaacccggccattaccagggtgaagatttaaccgttgtcagtgcctttgaagccgtaggaaagtatagcgcgggtaaaatagatgataacgaattattagccattgaacgcaatgcttgtccgggtgcggggtcttgtgggggaatgtttactgctaacaccatgtcatccgcgtttgaagcgatggggatgagtttaccctattcttctaccatggccgcagaagatgctgaaaaagccgatagtaccgaacaatcggcctttgttttggttgaggctatccgtaaacagattttacctagtcagattttaacccgtaaagcctttgaaaatgcgatcgcggtcattatggctgtcggagggtcaaccaatgcagtattacacctattagccattgctaataccatgggggttgagttgactatcgacgactttgaaaccattcgtaaaaaagttccagttttgtgtgatctcaaaccatcgggacgctacgttaccgttaatttacatcaagcagggggcattccccaagtgatgaaaatgctgttaaaccatggattattacacggggatgcgttaaccatttccggacaaactatcgcggaagttttgcaagatattcccgatgaacctcccgcgaatcaagatgtcattcgtccttggaataacccggtttatccagaaggacatttagccatcctcaaagggaatttagccgcagaaggtgcggtagctaaaattagtggggtcaaaaaacctaagatgaccggtccagcaagggtttttgagtcagaagaagcgtgtttagacgcaattttagccggaaaaattagcgcgggagatgtcgttattgttcgctacgaaggacccaaaggaggccccggaatgcgagaaatgttagcccccacgtctgctattattggcgcaggattaggtgattcagtgggattaattaccgatggacggttctctggaggaacctacgggttagtggttggccatgtcgctcctgaagcctttgttggcggtacaattgccttagttaacgagggagatagtgtcaccattgatgcagaaaaacggctattgcaattaaatgtttctgacgaagaattagctacccgtcgcgctcattggactccccctaaaccgcgctatcaacggggaattttagggaagtatgctaagttagtttcttcgagtagtttaggcgcagtgaccgatgtagagctattctag

SEQ ID NO: 439 - protein, 567 aa, Thermus aquaticus
MRSDRIKKGLQQAPARSMLRAVGVGDEDFGRPFVGVVNTFTDGMPCNYHLRELALDLKEGLREAGVFPFEFGAPAISDGISMGTPGMRASLVSREVIADSIELVAQGYLYDGMAVLSACDKTIPGGAMGVIRSGVPGMVLYGGTIAPGEWRGRKLTIVEVFEAVGQRAAGRITDEELLEIERRAIPGPGACGGQYTANTMAMALEVLGLSPMGYNAIPAVHPEKPRATKEAGRILAWAIEHDWKPQDFLTRRSFLNAIAAVAATGGSTNAVLHLLAMAKEVGVELSLDDFDRVSRKTPIIADLRPWGTYAAWELYEAGGTPLVFKRLLEAGLLFGEEKTLTGRTLAEEVEQAFREAEGQKVVFPVERALKPQGGLVVLRGNLAPRGAVLKLAGTERTYFEGPARVFDSEEEAMAKVLAKEIHPGDVVVIRYVGPKGAPGMPEMLSVTSAIVGEGLGPEVALLTDGRFSGGTRGLMVGHIAPEAFVGGPIALLKEGDRVRIDVENRLLEVLLPEEELARRKESWKPRPPAFRHGVFARYAALVAQADEGAVLETPHAGMGAEGPPRAF

SEQ ID NO: 440 - DNA, 1704 bp, Thermus aquaticus
atgaggtcggatcggatcaagaaaggcttacagcaggccccggcccggagcatgctccgggcggtgggcgtgggggacgaggactttgggaggcccttcgtgggggtggtcaacaccttcaccgacgggatgccctgcaactaccacctgagggagctggccctggacctgaaggaggggctcagggaggccggggtcttcccctttgagttcggggcccccgccatctccgacggcatcagcatgggcaccccggggatgcgggcgagcctcgtaagccgcgaggtcatcgccgatagcattgagctcgtcgcccagggctacctctacgacggcatggcggtcctctccgcctgcgacaagaccatccccggcggcgccatgggggtcatcaggagcggggtccccggcatggtcctctacggggggaccatcgcccccggggagtggcggggccgtaagctcaccatcgtggaggtctttgaggccgtgggccagcgggcggcgggcaggatcaccgacgaggagcttttggagattgagcgccgggccatccccggccccggggcctgcggggggcagtacacggccaacaccatggccatggccctcgaggtcctgggcctctccccaatgggctacaacgccatccccgccgtccacccggaaaagcccagggccaccaaagaggcgggaaggatcctggcctgggccatagagcacgactggaagccccaagacttcctcacccggaggagcttcctgaacgccatcgccgccgtggccgccacgggcggcagcaccaacgccgtgctgcaccttctggccatggccaaggaggtgggggtggagctcagcctggacgactttgaccgggtctcccgcaagacccccatcatcgccgacctccggccctggggtacctacgccgcctgggagctttatgaagcggggggcacgcccctggtcttcaaaaggcttctggaggcgggcctcctctttggcgaggagaagaccctcaccgggcgcaccctggcggaggaggtggaacaggccttcagggaggccgaagggcaaaaggtggtcttccccgtggagcgggccctgaagccccagggcgggctcgtggtcctccgggggaacctggccccgaggggagcggtcttgaagcttgcgggcacggagcgcacctactttgagggcccggcccgggtgtttgactccgaggaggaggccatggccaaggtcctggccaaggagatccaccccggggacgtggtggtcatccgctacgtggggcccaagggggcccctggcatgccggagatgctttcggtgaccagcgccatcgtgggcgagggcctgggccccgaggtggccctcctcaccgacgggcgcttctccgggggcacccggggcctcatggtggggcacatcgcccccgaggcctttgtgggcgggcccatcgccctcctcaaggagggggaccgggtgcgcatagacgtggaaaaccgcctcctggaggtcctcctccccgaggaggagcttgcgaggcggaaggaaagctggaagccacgcccccccgccttccgccacggcgtgttcgcccgctacgccgccctggtggcccaggccgacgagggcgcggtgctggaaacgccccacgctggcatgggggcggaaggtccacctagggccttttga

SEQ ID NO: 441 - protein, 561 aa, Cyanothece sp.
MSDNYRSRIITEGSQRTPNRAMLRAVGFGDDDFTKPIVGIANGYSTITPCNMGINDLALRAEDGLKKAGAMPQIFGTITISDGISMGTEGMKYSLVSRDVIADSIETVCNGQSMDGVIAIGGCDKNMPGAMIAMARMNIPAIFVYGGTIKPGHYNGEDLTVVSAFEAVGQYSAGKIDDAQLSGIERNACPGAGSCGGMFTANTMSSAFEVMGMSLPYSSTMAAEDAEKADSTEKSAFVLVEAIKKQILPRQILTRKAFENAISVIMAVGGSTNSVLHLLAIAHTIGVELSLDDFETIRKRVPVICDLKPSGRYVTVNLHQAGGIPQVMKMLLVHDLLHGDALTITGQTIAEVLKDVPDEPPLGQDVIRPWDNPVYQEGHLAILKGNLATEGAVAKISGVKVPKITGPARVFESEESCLEAILAKRIKPGDVIIVRYEGPKGGPGMREMLAPTSAIIGAGLGDTVGLITDGRFSGGTYGMVVGHVAPEAAVGGTIALVEEGDTITIDAHQRLLQLNVSDEELARRRAKWQPPQPRYTTGVLAKYAKLVSSSSIGAVTDKDLF

SEQ ID NO: 442 - DNA, 1686 bp, Cyanothece sp.
atgtcagataattatagaagtcgcatcattactgaagggagtcaacgcactcctaaccgggctatgcttcgcgccgttggatttggagatgatgactttactaaacccatagtgggcattgctaacggatatagcacgattaccccttgtaatatggggattaatgacctggcactaagggccgaagacggactgaaaaaagcgggagctatgccccaaatttttggcacaattaccatcagtgatgggatttctatgggaacagaagggatgaaatattctcttgtctctagggatgtaatcgccgactccatcgaaactgtctgtaatggtcaaagtatggatggagttatagcgatcgggggttgtgataaaaatatgcccggagctatgattgctatggcgagaatgaatattccggcgatttttgtttatggaggcacaattaaacccggacactacaatggagaagatttaactgttgtgagtgcttttgaagctgtcggacaatatagcgcgggtaaaatagacgatgcccagttatcaggaattgaacgcaatgcctgtccgggggcgggttcttgtgggggtatgtttaccgctaataccatgtcttctgcgtttgaagtgatggggatgagtcttccctattcctctacaatggcggcagaagatgcagaaaaagccgatagtaccgaaaaatccgcttttgttttagtggaggcgattaaaaaacaaattctcccccgtcagattttaactcgcaaagcttttgagaatgctatctcggtgattatggcggttggcggttcgaccaattcggttttacatttattggcgatcgctcataccataggggtagaactgagtttagatgactttgaaaccattagaaagcgagtgccggtcatttgtgacctgaaaccctctggacgctacgttacggttaatttacatcaagctggtggtattcctcaagtgatgaaaatgctgttagtccatgacttattacatggggatgctttaactattaccggacaaaccattgcagaagttttaaaagatgtccccgatgaaccccctctaggtcaagatgtgattcgtccttgggataaccccgtttaccaagaaggacacctagctattttaaaaggaaacttagctacagagggagcagtagctaaaattagtggggtcaaagttcctaaaattactggacctgcccgggtctttgaatcagaagaaagttgtttagaagccattcttgccaagagaattaagccgggagatgtgattatcgtccgttatgaagggccaaaaggaggccccggaatgcgggaaatgttagcgcctacctctgctattattggggcaggattaggggatacagtgggattaattaccgatgggcgtttttctggaggaacttacggcatggtcgttggtcatgttgctcctgaagccgcagtaggcggtactattgccctcgtagaagaaggcgatacgatcaccattgatgctcatcaacgcttattacagcttaatgtgtctgatgaagaattagcccgtcgtcgtgctaagtggcaaccccctcaacctcggtatacaacaggggtattggctaagtatgctaaattagtctcttcgagtagtatcggggcagtgacggataaagatttattttaa

SEQ ID NO: 443 - protein, 557 aa, Acidithiobacillus ferrooxidans
MSDNRRSKTITQGVQRSPNRALLRAVGFGDWDFDKPIVGVANAHSSITPCNIGIGVLAARAEAALKSAGAMPQTFGTITISDGISMGTAGMKYSLVSREVIADSIETVCQGQSMDGVLALGGCDKNMPGAMIAIARMNIPAIFVYGGTIKPGHYRGQDLTIMSAFEAVGQHTVHKIDDEELLEIERRACPGAGSCGGMYTANTMSSIFEAMGMSLPYSSTMAAEDAEKAESAAQSAEVLVSAIRKQILPRQILTRQAFENAIAVAMAVGGSTNAVLHLLAIAHAAQVPLTLDDFEAMRERVPVLCDLKPSGRYVSTDLHRAGGIPQVMKILLAHGVLHGDALTISGQTLAEVLQDVPSEARTDQEVIRPWNNPIYAQGHLAILKGNLAPEGAVAKTTGFMAHKITGPARVFESEESCMEAILAQKIKPGDVVVIRYEGPKGGPGMREMLSPTSAIIGEGLGDSVGLITDGRFSGATYGMVVGHVAPEAAVGGTIALVIEGDSVTIDAGQRLLQLNVSDEEIGRRRAVWQAPAPRHTRGVLAKYAKLVSSASKGAVTD

SEQ ID NO: 444 - DNA, 1674 bp, Acidithiobacillus ferrooxidans
atgtctgacaaccgcagaagcaagaccatcacgcagggcgtgcagcgctcgcccaaccgggccctgctgcgtgcggtggggtttggtgattgggacttcgacaagcctatcgtcggcgtggcgaacgcgcacagcagcatcacgccttgcaatatcggtatcggcgtgcttgccgcccgtgcggaagcggcgctcaaatcggctggtgccatgccgcaaacgtttggcaccatcaccatttccgatggtatttcgatgggtaccgccggcatgaaatattcgctggtgtcacgcgaagtgattgccgactccattgaaacggtgtgtcagggccagagcatggacggcgtgctcgccctcggcggctgcgataagaacatgccgggcgcaatgatcgccatcgcccgcatgaacattccggccattttcgtttatggcggcaccatcaagccgggccactaccggggccaagatctgaccatcatgagcgcctttgaggcggtggggcaacacaccgtccataaaattgacgacgaagaactgctggaaatcgagcgtcgcgcctgccctggcgcgggctcctgcggcggcatgtataccgccaacaccatgtcttccatcttcgaagccatgggcatgagcttgccgtactcctccaccatggcggcggaggatgcagaaaaggcggagagtgcggcacagtccgcagaggtattggtaagcgccatccgaaaacaaatcctgccgcgccagatattgacgcggcaggcgtttgaaaacgccattgcggtggccatggccgtgggcggctccaccaacgcggtattacacctgttggccattgcgcatgcggcacaggtaccactcacccttgatgatttcgaggccatgcgcgagcgtgtgccggtactctgcgacctgaaaccatcgggccgttacgtctctaccgatctgcatcgggcgggcggcattccccaggtgatgaaaatattgctcgcccacggcgtgttacacggcgatgcgctgaccatcagcggtcagacgcttgcggaagttttacaggatgtgccgagcgaagcgcgtacggatcaggaggtgatacgtccgtggaataatcccatttatgcccaagggcaccttgccatcctgaagggcaatcttgcgcccgagggcgcggtggcgaaaaccaccggcttcatggcgcacaaaatcaccggtccggcacgggtttttgaatccgaggagtcgtgcatggaagcgatcctggcgcagaaaatcaagcccggcgatgtcgtggtcatccgctacgaagggcccaagggcggacccggtatgcgcgaaatgttatcccccacctcggcgatcatcggcgaaggattgggcgattcggttggccttattactgacggccgcttttccggcgccacatacggcatggtagtcggtcatgtcgcgccggaagccgcagtggggggcacgatcgcactagtcatcgagggagactcggtgactatagacgccggacagcgtttgctgcaactcaacgtgtctgatgaagaaatcggacgccgccgcgccgtctggcaagcacccgcaccgcgccacacgcgcggcgttttggcgaagtacgccaaattggtttcctcggccagtaagggggccgtaacagattga

SEQ ID NO: 445 - protein, 567 aa, Cyanothece sp.
MSVSSNQPINLRSQVVTQGVQRSPNRAMLRAVGFQDDDFAKPIVGVASAHSTITPCNMGIAPLAVRAEAGIRAAGGMPQVFGTITVSDGISMGTEGMKYSLVSRDVIADSIETACNAQSMDGVLAIGGCDKNMPGAMIAMARMNIPAIFVYGGTIKPGHLEGEDLTVVSAFEAVGQYSAGRIDEVRLMSVERNACPGAGSCGGMYTANTMSSAFEAMGMSLMYSSTMSAVDPEKTENTELAGKVLVEAIRNNLRPRDIITRKSIENAISVIMAVGGSTNAVLHFLAIAHSAGVPLTLDDFEAIRERVPVLCDLKPSGRYVATDLHHAGGIPQVMKMLLNQGLLHGDCVTITGETIAERLRDVPDQPAADQDVIRPWSNPMYSSGHLAILKGNLATEGAVAKISGVKQPQITGPARVFDSEEDCLAAILAGKIKAGDVIVIRYEGPKGGPGMREMLAPTSAIIGAGLGDAVGLITDGRFSGGTYGMVVGHVAPEAFVGGTIALVQEGDSITIDAHQRLLQLNVTEAELIERRVAWSPPPPCYNRGVLAKYAKLVSSSSLGAVTDLNLL

SEQ ID NO: 446 - DNA, 1704 bp, Cyanothece sp.
atgtccgtcagttcaaatcagccgatcaatttaagaagccaggttgttacccagggcgtacagcgatcgcctaatcgggccatgctacgggccgtggggttccaggatgacgattttgccaaaccgatcgtgggggtggccagtgcccacagtacaattaccccctgcaacatgggcattgctcccctggctgtgcgggcagaagcgggaattcgagcagcgggcgggatgccccaggtgtttggcaccattaccgtcagtgatggtatttcgatgggaacggagggaatgaaatactctttggtttcccgcgatgttattgctgattcgatcgaaactgcctgtaatgctcagagtatggacggtgttctagccatcggtggttgtgacaagaatatgccgggagccatgattgcgatggcccggatgaatattccggcaatttttgtctacggtggcaccattaaaccggggcatctggaaggggaagacctcaccgtggtcagtgcctttgaagcggtggggcagtacagtgctggcagaattgacgaagtgcgcctgatgtcggtggaacgcaatgcctgtccgggggcggggtcttgcggcggtatgtacacagccaacactatgtcttcggcttttgaagcaatgggcatgagcctgatgtactcctccaccatgtcagcggtagacccggaaaaaactgaaaacaccgaactggcgggtaaagtgctggtggaggcgattcgtaataatctgcgtccgcgagatatcatcacccgtaaatcgatcgaaaacgcaatttccgtgattatggcggtcggtggctccaccaatgcggtgctgcattttctcgccattgcccattcggctggggttcccctcaccctggatgactttgaagccattcgcgaacgggttccggttctctgtgatctgaagccctctggccgttacgttgctactgatttacatcatgcgggtggcattccccaggtaatgaaaatgctgctgaatcagggcttactccacggcgattgtgtcacgattacgggggaaaccattgccgagcgcctgcgggatgtgcccgatcaaccggcagcggatcaggatgtgattcgcccctggtctaaccccatgtatagcagtggtcacctggccattttgaaggggaatttggcgaccgaaggggccgtggccaagattagtggtgttaaacaacctcagattactggaccagcgcgggtgtttgactctgaagaggactgcctggcagcgattctggcgggaaagatcaaggctggcgatgtgattgtgatccgctatgaaggacccaagggtggaccggggatgcgggaaatgctggctccgacctctgccattattggggctggtctgggagatgcggtgggtttgattacagatggcagattttcaggcggtacctacgggatggtggttggccacgtcgctcccgaagcgtttgtgggaggcacgatcgccctggtgcaggaaggggattcgattacgatcgatgcccatcagcgcctgttacaactgaacgtgactgaggcagaactaattgaacgccgtgtcgcctggagtccgccgccgccctgctataaccgtggtgtgctggccaaatacgccaaactggtctcctccagcagtttgggagctgttacagacttaaatctattgtaa

SEQ ID NO: 447 - protein, 572 aa, Arthrobacter chlorophenolicus
MSESQIETESKPDIKPRSRVVTDGIHAAPARGMFRAVGMGDDDFAKPQVGVASSWNEITPCNLSLNRLAQGAKEGVHAGGGFPMQFGTISVSDGISMGHEGMHFSLVSREVIADSVETVMQAERIDGSVLLAGCDKSLPGMLMAAARLNLSSVFLYAGSIMPGWVKLEDGSEKEVTLIDAFEAVGACAAGKMSMEDLTRIEKAICPGEGACGGMYTANTMACIGEALGMSLPGSAAPPSADRRRDDFARKSGEAVVNLLRKGITARDIMTKEAFENAIAVTMAFGGSTNAVLHLLAIAREAEVELTLDDFNRIGDRIPHLGDLKPFGRYVMTDVDKIGGVPVIMKALLDAGLLHGDCLTVTGKTVAENLEAINPPDVDGKILRAMDNPIHKTGGITILHGTMAPEGAVVKTAGFDADVFEGTARVFDREQGALQALDQGEIHAGDVVVIRYEGPKGGPGMREMLAITGAIKGAGLGKDVLLLTDGRFSGGTTGLCIGHVAPEAVDGGPIAFVRDGDRIRVDIAARSFDLLVDDAELEARKVGWEPLPARYTKGVLAKYAKLVHSASTGAYCG

SEQ ID NO: 448 - DNA, 1719 bp, Arthrobacter chlorophenolicus
atgagtgagagccagatcgaaacagagagcaagcctgacatcaagccccgcagccgggtggttaccgacggaatccacgccgcaccggcgcgcggcatgttccgtgcggtcggcatgggcgacgacgacttcgcgaagccccaggtcggggttgcgagttcgtggaacgagatcactccctgcaacctctccctgaaccggctggcccagggcgccaaggagggtgtccacgccggtggcggcttccccatgcagttcggcaccatctccgtgtccgacggtatttccatgggccacgagggcatgcacttctccctggtctcccgcgaagtgatcgccgattccgtcgaaaccgtcatgcaggccgagcggattgacggttcggtcttgctcgccggctgcgacaagtcccttcccggcatgctcatggccgcggcccggctcaacctgtccagcgtgttcctctacgccggctcgatcatgccgggctgggtaaagctcgaggacggctccgagaaggaagtcaccctcatcgatgcctttgaggccgtgggcgcctgcgccgccggcaagatgagcatggaagacctcacgcgcattgaaaaggccatctgtcccggcgaaggcgcctgcggcggcatgtacacggccaacaccatggcctgcatcggtgaggcgctgggcatgtccctgcccggatctgccgccccgccctcggcagaccgccgtcgtgatgactttgcgcgcaagtccggtgaagcagtggtgaacctgctgcgcaagggcatcaccgcccgcgacatcatgaccaaggaggcctttgaaaacgccatcgccgtcaccatggcgttcggcgggtccaccaacgcggtcctgcacctgctggccattgcccgcgaagccgaggtagagcttaccctcgacgacttcaaccgcatcggtgacaggatcccgcacctcggcgacctcaagccgttcggccgctacgtcatgaccgacgtcgacaaaatcggcggcgtgcccgtcatcatgaaggcactgctcgacgccgggctgctgcacggcgactgcctcaccgtcaccggcaagaccgtggcggaaaacctggaagccatcaacccgccggatgttgacggcaagatcctgcgcgcaatggacaaccccatccacaagaccggcggcatcaccatcctgcacggcaccatggcgccggaaggcgccgtagtgaagactgcaggattcgacgccgacgtcttcgaggggaccgcccgcgtgttcgaccgcgagcagggcgccctgcaggcgctggaccagggcgaaatccatgccggcgacgtcgtggtcatccgctacgaggggcccaagggcggcccgggcatgcgggagatgctggccatcaccggcgccatcaagggcgcgggcctcggcaaggacgtcctgctgctgaccgatggccggttctccggcgggaccaccgggctgtgcatcggccacgtcgcgccggaagcggtggacggcggccctatcgccttcgtcagggacggtgaccggatccgcgtggacatcgccgcgcgcagcttcgacctgctggtcgatgacgccgagcttgaggcccgcaaggttggctgggagccgctgccggcccgctacaccaagggcgtcctggccaagtacgccaagctcgtgcacagcgcgagcaccggcgcatactgcggctga

SEQ ID NO: 449 - protein, 557 aa, Burkholderia multivorans
MSYNRRSKHITQGVARSPNRSMYYALGYQKEDFDKPMMGIANGHSTITPCNAGLQRLSDAAVEAIKAAGANPQIFGTPTISDGMSMGTEGMKYSLVSREVIADCIETCVQGQWMDGVVVVGGCDKNMPGGMIALARLNVPGIYVYGGTIRPGHWKGKDLTIVSAFEAVGEFTAGRMSDEDFEGIERNACPTSGSCGGMYTANTMSSSFEALGMSLMYSSTMANPDQEKVDSAAESARVLVEAVKRDLKPRDIITKQSIENAVSLIMATGGSTNAVLHYLAIAHAAEVDWTIDDFERIRKRVPVICDLKPSGRYVATDLHRAGGIPQVLKILLDAGLLHGDCVTITGRTLAEELKDVPSVPRTDQQVIFPIERALYKEGHLAILKGNLAEDGAVAKITGLKNPVITGPARVFDDEQSAMDAILGDKIRAGDVLVLRYLGPQGGPGMPEMLAPTSAIIGKGLGESVGFITDGRFSGGTWGMVVGHVAPEAFVGGTIALVQEGDSITIDAHKLLLQLNVDDAELARRRAAWKQPAPRYTSGVLAKYAALARPANRGAVTG

SEQ ID NO: 450 - DNA, 1674 bp, Burkholderia multivorans
atgtcgtacaaccgtcgctcgaagcacatcacgcaaggcgtcgcccgctcgccgaaccgttcgatgtattacgccctcggctatcaaaaggaagatttcgacaagccgatgatgggcatcgccaacgggcattcgacgatcacgccgtgcaacgcagggctgcagcgcctgtccgacgcggccgtcgaggcgatcaaggcggccggcgcgaatccgcagatcttcggcacgcccacgatctcggacggcatgtcgatgggcaccgaagggatgaagtactcgctcgtgtcgcgcgaggtgatcgccgactgcatcgagacctgcgtgcagggccaatggatggacggcgtcgtggtggtcggcggctgcgacaagaacatgccgggcgggatgatcgcgctcgcgcggctgaacgtgccgggcatctatgtgtacggcgggacgatccgcccgggccactggaaaggcaaggatctgacgatcgtctcggcgttcgaggcggtcggcgaattcacggccgggcgcatgtcggacgaggatttcgaaggcatcgagcgcaacgcgtgcccgacgtcgggctcgtgcggcggcatgtacaccgcgaacacgatgagctcgtcgttcgaggcgctcggcatgtcgctgatgtattcgtcgacgatggcgaaccccgatcaggaaaaggtcgattcggccgccgaatcggcgcgtgtgctcgtcgaagcggtgaagcgcgacctgaagccgcgcgacatcatcacgaagcagtcgatcgagaacgcggtgtcgctgatcatggcgaccggcggctcgaccaatgcggtgctgcactatctcgcgatcgcgcatgcggccgaggtcgactggacgatcgacgacttcgagcggatccgcaagcgtgtgccggtgatctgcgacctgaagccgtcgggccggtacgtcgcgaccgacctgcaccgtgcgggcggcattccgcaggtgctgaagatcctgctcgatgcgggcctgctccacggcgactgcgtcacgatcacgggccgcacgctcgccgaagagctgaaggacgtgccgtccgtgccgcgcaccgaccagcaggtgatcttcccgatcgagcgcgcgctatacaaggaaggccatctcgcgatcctgaagggcaatctcgccgaggacggcgcggtcgcgaagatcaccgggctgaagaacccggtgatcacgggcccggcgcgcgtgttcgacgacgagcaaagcgcgatggacgcgatcctaggcgacaagatccgcgccggcgacgtgctcgtgctgcgctatctcggcccgcaaggcggccccggcatgcccgaaatgctcgcgccgacgtcggcgatcatcggcaaggggctcggcgaatcggtcggcttcatcaccgatggccgcttctccggcggtacgtgggggatggtcgtcggccacgtcgcgcccgaggccttcgtcggcggcacgatcgcgctcgtgcaggaaggcgactcgatcacgatcgacgcgcataagctgctgctgcagctgaacgtcgacgatgcggagctcgcgcgccgccgcgccgcatggaagcagccggcgccgcgctatacgagcggcgtgctcgccaagtatgccgcgctcgcacggccggcgaatcggggcgcggtcacggggtga

SEQ ID NO: 451 - protein, 556 aa, Thermomicrobium roseum
MRSERITHGIDRAPARAMLRAVGFRDEDFDKPIVAIANTWTDAMPCNYHLRELAQHLREGIREAGGVPVEFNTIAVNDAISMGTEAMKASLISREVIADSIELMAYGYQFDALVAIVSCDKTIPGGAMGVIRAGVPAMVLYGGSIAPGHWRDRELTIVEVFEAVGAYAAGKITLEELQEIERRAIPGPGACGGQYTANTMAMALEVMGLSPMGYNAIPAIAPEKASATREAGRRFMEVVRANRTPRDFLTKTSLRNAIAAVAATGGSTNAVLHLLAIAHELGIPLSIDEFDEISQRTPIIADLKPWGKYVAWSLYKAGGTKLVVKRLLEAGLVDGDARLVTGETLAEAVADAQEAPGQPVVYHPSAPLKPHGGLVILRGSLAPEGAVLKVAGTEQMYFRGTARVFDAEEQAMQAVLNQQIKPGDVVVIRYEGPKGGPGMREMLGITAAIVGEGLGPHVALVTDGRFSGGTKGLMIGHVAPEAPVGGPIAFVQDGDTIVIDVEKRRIDLEVSETELAERRSRWSPPAPRFTNGVFARYAALVSSASQGAVLRTPAWQ

SEQ ID NO: 452 - DNA, 1671 bp, Thermomicrobium roseum
atgcgcagtgagcggatcacgcacgggatcgatcgagcaccggcccgcgccatgctgcgagcagtcggttttcgcgacgaggacttcgacaaaccgatcgtcgcgatcgccaatacgtggaccgatgcgatgccgtgtaattaccacctgcgggaactcgcccagcacttgcgcgagggtatccgcgaggctggcggtgtaccagtcgagttcaacacgatcgcggtgaacgatgccatctcgatgggaaccgaagcgatgaaggcctcgctgatcagtcgcgaggtgatcgctgactcgatcgaactcatggcgtatgggtaccagttcgatgccctggtcgctatcgtctcctgtgacaagacgattccaggaggggcgatgggggtgattcgtgctggggttcctgccatggtgttgtacggaggctcgatcgctcccgggcactggcgtgatcgcgaactcacgatcgtggaggtctttgaagcggtaggggcttacgcggccggaaagatcacgctggaggagctgcaggagatcgagcgacgcgcgatcccgggaccgggagcctgtggtgggcaatatacggcgaacacgatggcgatggcactcgaagtgatgggcttgtcgccgatgggctacaacgcgataccagcgatcgcgccggagaaggcttcagcaacccgcgaggctggccgtcgcttcatggaggtcgtccgggcgaaccgaacgccgcgcgatttcttgaccaagacctcgctgcgtaacgcgatcgctgcagtggctgcaacgggcgggtcgaccaacgcggttttgcacctcctggcgatcgcgcacgagttgggtattccgctgagcatcgacgagttcgatgagatcagccagcgaacgccgatcatcgctgatctcaaaccgtggggtaaatacgtggcatggagcctctataaggctggcgggaccaagctcgtggtgaagcgactcctcgaggctggactcgtcgatggggatgctcgtttggtgacgggtgagaccctggccgaggcagtcgctgatgctcaggaggctcctggtcagccggtcgtctatcatccgtccgctccgttgaaaccgcatggtggtctggttatcctgcgtggatcgctcgctcccgagggtgctgttctgaaagtcgccggcacagagcagatgtacttccgcggaacggctcgcgtcttcgacgccgaagagcaagcgatgcaagcggtcctcaaccagcagatcaagccaggcgatgtggtggtcattcggtacgaggggcccaagggtggtccgggcatgcgggaaatgctggggatcacggcagcgatcgtgggtgaggggctcggtccgcatgtcgcgctggtcaccgatggccggttctcaggcggtaccaagggactcatgatcggccatgtagcacccgaagcgccggtgggtggaccgatcgccttcgtccaggatggtgacaccatcgtgatcgacgtggagaagcggcggatcgatctcgaggtgtcagagacggaactcgccgaacggcgttcgcgctggtcgccgccagcaccacggttcacgaatggggtcttcgcgcgctacgctgcgctcgttagctctgcctcgcagggtgctgtcttgcggacacctgcctggcaatga

SEQ ID NO: 453 - protein, 577 aa, bacterium Ellin514
MKNNSKASKSPKADNLRPYSSLVLDGPERAPSRAMLYPVGFKPEDFKKPLIGIASTWSMVTPCNMHIDKLALEAEKGANAAGGKAIIFNTITISDGISMGSEGMKYSLVSREVIADSIETVVGCEGMDGYVAIGGCDKNMPGALMAIARMNRPAVFAYGGTILPGCITGDTRKLDVVSVFEAVGAHANKKISDGELQAIESCAIPGPGSCGGMYTANTMASAIEALGMSLPNSSAQAAISPAKKDDCQRAGAAVVNLIKKGIRPLDIMTKKAFENAITVVIALGGSTNAVLHLLAMANAAKVKLSLDDFTRIGKKVPVLADLKPSGKHLMSELVAIGGIRPLMKTLLDAGLLHGDCLTVSAQTLAEDLKGVRPYPVGQTIIRPLNDPIKKDSHLVVLYGNLSPEGSVAKITGKEGLRFEGRARVFNSEELALKKILDGGIKKGDVVVIRYEGPKGGPGMREMLSPTSAIMGKGLGKEVALITDGRFSGGTHGFVVGHITPEAHVGGPLALVKEGDTIVIDAEKRELSVNISAKEMAARRKTWKQPKARYTRGVLAKYAHLVTSASLGAVTDNNLNLE

SEQ ID NO: 454 - protein, 1734 aa, bacterium Ellin514
ATGAAAAACAATTCGAAAGCCAGCAAGTCGCCTAAAGCCGACAATTTGCGCCCCTATTCCAGCCTCGTCCTCGACGGCCCTGAACGCGCACCCAGCCGCGCCATGCTTTATCCCGTCGGTTTCAAACCCGAAGATTTCAAGAAGCCCCTCATCGGCATCGCCTCCACGTGGAGCATGGTTACCCCGTGTAACATGCACATCGATAAACTCGCGCTCGAAGCCGAGAAAGGCGCCAACGCCGCCGGCGGCAAGGCCATTATTTTCAATACCATCACCATCTCCGACGGCATCTCCATGGGTTCCGAAGGTATGAAATATTCCCTCGTCTCCCGCGAAGTCATCGCCGACTCCATCGAAACCGTCGTTGGTTGCGAAGGCATGGACGGCTATGTCGCCATTGGTGGTTGCGATAAAAATATGCCCGGCGCCCTGATGGCCATCGCCCGCATGAACCGTCCCGCCGTCTTCGCTTATGGCGGAACAATCCTCCCCGGCTGCATCACTGGCGACACGCGCAAGCTCGACGTCGTCTCCGTCTTCGAAGCCGTCGGTGCTCATGCCAACAAGAAAATCAGCGACGGCGAACTGCAAGCCATCGAGTCCTGCGCCATCCCTGGCCCCGGCTCATGCGGCGGCATGTATACTGCCAACACCATGGCCAGCGCGATCGAAGCACTCGGCATGAGCCTGCCGAACAGCTCAGCTCAAGCCGCGATCTCTCCGGCCAAGAAGGATGATTGCCAGCGCGCCGGTGCCGCCGTGGTTAACCTGATCAAGAAAGGCATCAGGCCGCTCGACATCATGACCAAAAAGGCGTTCGAAAATGCCATCACGGTCGTCATCGCTCTCGGTGGCTCGACCAATGCCGTTCTCCACCTGCTCGCCATGGCCAATGCCGCCAAGGTAAAACTCTCGCTCGATGATTTCACCCGCATCGGCAAAAAGGTTCCTGTCCTCGCCGATCTCAAACCCAGCGGCAAACATCTCATGTCGGAACTCGTCGCCATCGGCGGCATACGTCCTTTGATGAAAACCTTGCTCGACGCCGGCTTGCTTCATGGCGATTGCCTCACCGTCAGCGCCCAGACTCTCGCGGAAGACCTCAAAGGCGTGCGCCCCTACCCCGTTGGTCAGACAATTATCCGTCCACTCAACGATCCCATCAAGAAGGACAGCCATCTCGTCGTCCTCTATGGCAATCTTTCTCCCGAGGGTTCCGTTGCCAAGATTACCGGCAAGGAAGGTCTCCGCTTTGAAGGCCGCGCCCGCGTCTTCAACTCCGAAGAACTCGCCCTCAAAAAGATTCTCGATGGCGGCATCAAGAAAGGTGATGTCGTGGTCATACGCTACGAAGGCCCCAAGGGTGGCCCCGGCATGCGTGAAATGCTCAGCCCCACTTCCGCCATCATGGGCAAAGGCCTCGGCAAGGAAGTCGCCCTTATCACCGACGGTCGCTTCTCCGGCGGCACCCATGGTTTCGTGGTCGGCCACATCACCCCGGAAGCCCACGTTGGCGGTCCTCTCGCACTGGTGAAGGAAGGCGACACCATCGTCATCGATGCAGAAAAACGTGAACTCTCCGTAAACATTTCCGCGAAGGAAATGGCTGCCCGTCGCAAAACTTGGAAGCAGCCCAAGGCCCGTTACACCCGTGGCGTACTCGCCAAATATGCCCACCTCGTCACCTCCGCATCATTAGGCGCCGTGACCGACAATAATTTAAACCTCGAATAA

SEQ ID NO: 455 - protein, 559 aa, Desulfobacterium autotrophicum HRM2
MAEKLNLYSSRITGPKSQGASQAMLYGAGLTDADMEKAQVGISSVWYEGNPCNMHLNDLAALVKEGVVNSGLVGLRFNTIGVSDGISMGTSGMSYSLQSRDLIADSIETVMQAQWYDANISLPGCDKNMPGCLIAMARVDRPALMIYGGTIRAGCLDGNKLDVVSAFQSYGEYLAGKINDDQRRAIVKNSCPGAGACGGMYTANTMASAIEAMGMSLPYSASSPANSQAKQKECLQAGAAIRTLLEKNIKPSHIMTPKAFENAMVVITALGGSTNAVLHMIAIARSINVPLTIDDFQRISDRVPLLADMKPSGQYLQEDLNNVGGIPGVMKRLLHAGLLHGDCLTVTGKTLAENLKDLPPLQSGQQVIRPLTHPVHPRGHIQILKGSLAPEGAVAKLTGKEGLRFTGPANVFDSEEDMLLALENGKIHKGDVIIIRFEGPKGGPGMPEMLTPTSAIMGAGLGKDVALLTDGRFSGGSHGFIVGHITPEAQEGGPIALVQNGDPITIDADTNIIDVDILESELKRRQRSWQAPPLKAVRGTLFKYIKNVSSASKGCVTDE

SEQ ID NO: 456 - DNA, 1680 bp, Desulfobacterium autotrophicum HRM2
atggcagaaaaactaaatttatacagctcccgcatcacaggtcccaagtcccagggagcatcccaggccatgttgtacggtgccggactgaccgatgcggatatggagaaggctcaggtggggatcagcagtgtctggtacgagggcaacccctgcaatatgcatctcaacgatctggctgcccttgtgaaagaaggcgtggtaaattcaggccttgtggggctcagatttaataccatcggggtgagtgacgggatctccatggggacttccggtatgagctattcgctccagtccagggatttaattgccgattccattgaaaccgtcatgcaggcacaatggtatgatgccaacatttctttacccggatgcgacaaaaacatgcccggctgcctgatcgctatggcaagggttgaccgcccggccctgatgatatacggcggcaccatacgagccggatgtctggacggaaataagctggatgtcgtctctgctttccagagttatggtgaatacctggccggaaaaatcaatgatgaccagcgtcgggccattgttaagaacagttgcccgggagcaggcgcatgcggcggtatgtacactgccaataccatggcctcggccatagaagccatggggatgtccctgccttacagtgccagcagcccggcaaattcccaggccaaacagaaggaatgccttcaggcgggggcggccattagaacccttttggaaaaaaatataaaacccagccatattatgacaccaaaggcatttgaaaatgccatggtggttattacggccctgggcggctccaccaatgcagtgctgcatatgattgccattgcccgttccatcaatgtccccctgaccattgatgattttcaaagaatcagtgaccgtgttcctttgctggcagatatgaaacccagcggtcagtaccttcaggaagatctgaataatgtgggcgggataccaggggtaatgaaacgattactccatgcgggtttactgcatggcgactgcctgaccgtaaccggaaagactttggctgaaaatttgaaagatctgccgccacttcaaagcgggcagcaggtcatccgtccgcttacccatccggttcaccccaggggccatattcagatcctgaaaggaagcctggcccctgaaggcgctgtggccaaactcacaggcaaggaagggctgcgtttcaccgggccggcaaatgtttttgattctgaagaggatatgctcttagctctggaaaacggaaaaatccataaaggtgatgtcatcatcatccgctttgaaggccccaaaggcggacccggcatgcctgaaatgctgacacccacctcagccattatgggggcaggtcttggtaaagatgtggccctgttaactgacggcaggttttcagggggatcccacggttttattgtgggacatatcacccctgaagcccaggagggcggccccatcgcactggttcaaaatggtgacccaattaccattgatgctgacaccaatataatcgacgtcgatatcttggaatctgaattgaagcggcgtcaaaggtcctggcaggctccgccccttaaggctgtccggggaaccttatttaagtacattaagaatgtatcctcagcatcaaaggggtgtgtaacggatgagtag

SEQ ID NO: 457 - protein, 561 aa, Thioalkalivibrio sp.
MTQDNRRSRVVTEGPRRTPNRAMLRAVGFGDDDFQRPIVGIANAHSTITPCNMGIGALAERAESAVRASGGMPQTFGTITISDGISMGTPGMKYSLVSREVIADAIETVVNGQSLDGLLATGGCDKNMPGAMMAIARLNVPAIFVYGGTIKPGRYKDQDLTIVSAFEAVGQHGAGKLSDEDLAGVERNACPGAGSCGGMFTANTMSSAFEAMGMSLPGSSTQAAEDPEKADSAARSAEVLLEAIHADRKPRDILTREAFENALAVVMAVGGSTNAVLHLLAIAHCANVPLALDDVERIRRKTPVLCDLKPSGRHVTTEFHAVGGTPQVMKILLNAGLLHRHCLTITGQTLSEVLADIPDAPPSNQTIIRPLDAPLYPQGHLAILKGNLAPEGSVAKITGLKSTSIRGPARVFESEEECLDAILAGGIQAGDVIVVRHEGPRGGPGMREMLAPTAAIIGAGLGDSVALITDGRFSGGTYGLVVGHVAPEAAQGGPIALVREGDIIEVDADRNRLALEVPEDELARRRSAWQAPPPRFDRGVLGKYSRQVGSASRGAVTDDFR

SEQ ID NO: 458 - DNA, 1686 bp, Thioalkalivibrio sp.
atgacccaggacaatcgacgcagccgcgtcgtcaccgaagggccacgccgcacccccaaccgcgccatgctcagggccgtgggcttcggtgacgacgacttccagcgccccatcgttggcattgccaacgcccacagcaccatcactccctgcaacatggggatcggggcactggccgaacgtgcggaatcggccgtacgagcctcgggcggcatgccgcagaccttcggcaccatcaccatctctgacggcatttcgatgggcaccccgggcatgaagtactccctggtgtcgcgcgaggtgatcgccgacgcgatcgagacggtcgtcaacggccagagtctggacgggctgctggccaccggcggctgcgacaagaacatgcccggcgccatgatggcgatcgcccggcttaacgtgcccgcgatcttcgtctacggaggcacgatcaagccgggacgctacaaggaccaggacctgacgatcgtcagtgcgttcgaggccgtcggacagcatggggcgggaaagctgtcggatgaagacctggccggcgtggagcgcaatgcctgcccgggagccggctcctgtggcggcatgttcacagccaataccatgtccagcgccttcgaggcgatgggcatgagtctgccgggctcgtcgacccaggcggccgaggacccggaaaaggccgactccgccgcccgttccgccgaggtcctcctggaggcgatccatgccgaccgcaagccgcgcgacatcctcacgcgcgaggccttcgagaacgccctggccgtggttatggccgtcgggggatcgaccaatgccgtgctccacctgctcgccattgcccactgtgccaacgtgccgttagctctggatgacgtagaacggatccgccggaaaaccccggtactgtgcgatctgaagccctccggtcgacacgtgaccacggaattccatgcggtggggggcacaccgcaggtcatgaagatcctgctgaacgccggtcttctgcacaggcactgcctgaccattaccggccagaccctaagcgaggtcctcgcagacatccctgatgcaccaccatcgaaccagaccatcatccgcccgctggatgcccccctgtacccgcaggggcacctggcgatcctgaagggcaatctggcgccggaaggcagcgtggccaagatcaccgggctcaagtccacttcgattcgcgggcccgcgcgcgtattcgaatccgaggaggaatgcctggacgccatcctggcgggcgggattcaggctggcgacgtcatcgtggttcgtcatgagggcccccgcggcgggcccggtatgcgcgagatgctcgcccccacggcagcgatcatcggcgcgggtctcggcgactccgttgcgttgattaccgacggacgcttctccggaggcacctacggtctcgtcgtcggacatgtcgctcccgaggcggcgcaaggtgggcccattgccctggtgcgcgagggcgacatcatcgaggtcgatgccgaccgtaatcgtctcgcgctcgaggtaccagaggacgaactggcgcgtcgccgcagtgcctggcaggcacccccgccgcgctttgatcgaggtgtgctcgggaagtacagccgtcaggtcggatccgccagtcgcggcgcggtcaccgacgactttcgctga

SEQ ID NO: 459 - protein, 560 aa, Flavobacteria bacterium
MAKELNKYSKHVTQDPTQPASQAMLHAIGLSKEDLKKPMIGIGSTGYEGNPCNMHLNDLAKEVKLGVQKANLTGLIFNTIGVSDGISMGTFGMRYSLPSRDIIADSMETVVQAMNYDGLATIVGCDKNMPGALMAMIRLNRPSIMVYGGTIASGCARGKKLDVVSAFEAWGEKVAGTIDEKAYQEVIENACPGAGACGGMYTANTMASAIEALGMTLPYNSSNPATGNEKPLDCVASGEALGLLIEKDLKPLDIITKKSLENAVRLIIVLGGSTNAVLHFLAIAKTANIDFTLEDFTRISSETPFLADLKPSGQYLMEDLHRVGGIPAVMKFMLQNDMLHGDCMTVTGKTIAENLQSVPDLIKDQDVIRPLNAPIKETGHIRILYGNLAEEGAVAKITGKEGVYFKGPAKVYEGEFLANDGIKAGEVKKGDVVVIRYEGPKGGPGMPEMLKPTAAIMGAGLGKEVALITDGRFSGGTHGFVVGHVSPEAQVGGTIGLVQDGDIITIDASSNTISLDIDIAELNKRKALWVAPELKVSSGSLYKFANIVSSASKGCVTDVF

SEQ ID NO: 460 - DNA, 1683 bp, Flavobacteria bacterium
atggcaaaagaattaaataaatacagtaaacacgttacccaagatccaacccagcctgcttcacaggcaatgcttcacgctattggtctttctaaagaagaccttaaaaaacctatgataggaattgggagtacaggatatgagggaaatccttgcaatatgcatttaaatgatttggctaaagaagtaaagttgggggtccagaaagccaatcttactggacttatctttaataccattggggtaagtgatggtatttcaatggggacctttggaatgcgctattcgttgccttctagggatattattgcagattctatggaaacagtagttcaggcaatgaactatgatggtttggctaccatagtaggctgtgataaaaatatgcccggtgctttaatggcaatgataagattaaatagaccttccataatggtttatggaggaaccatagcctcaggctgtgcaagaggaaaaaaattagatgttgtctcagcttttgaagcatggggggagaaagtagctggcactatagatgaaaaagcgtatcaggaagtaattgaaaatgcctgccctggagctggtgcttgtggtggaatgtatactgcaaatacaatggctagtgctattgaagctttggggatgactttaccgtataattcttctaaccctgccacaggcaatgagaaaccattggattgtgtagcgtctggcgaagccttaggcttactaatagaaaaggatttaaaaccattagatataatcaccaaaaagtctttagaaaatgcggtgagattaatcatcgttttaggaggttctaccaacgcggtattgcattttttggctattgcaaaaacagcaaatatagattttacgctagaagactttaccagaatttctagtgaaaccccgtttctcgcagaccttaagcctagtggtcaatatcttatggaagatttacaccgtgtgggaggtatacctgcggtaatgaaatttatgcttcaaaatgacatgcttcacggtgattgtatgacggttactggaaaaacaatagcagaaaacctccaatctgttccggatcttataaaagaccaagatgtcataagacccctaaatgcaccaataaaagaaactggacatattaggattctttacggtaaccttgcggaagaaggtgcagtagctaaaattacaggaaaagaaggggtttatttcaaagggcctgctaaagtgtacgaaggagagtttttagccaatgatggtataaaagcaggagaagttaaaaaaggagatgtggtggtcattcgttacgaaggcccaaagggaggaccaggaatgccagaaatgttaaagcctacagcagccattatgggtgcgggtcttggcaaagaggtcgctttaattacagatggacgtttttctggaggtacccacggatttgtagtaggacacgtgtctcctgaagctcaagttggaggaaccattggattggttcaagatggagacattattactatagatgctagctcaaacaccatttcgttagatatagatatagcagaactcaataagcggaaagcattatgggtagcccctgaacttaaagtcagtagtggtagtttatataaatttgcgaacatagtttcttctgcatctaaaggatgcgtaacagacgttttttaa

SEQ ID NO: 461 - protein, 558 aa, Flavobacteria bacterium
MELNKFSKAVTQDPTQPAAQAMLHAIGMTDEDFKKPLIGIASTGYEGNPCNMHLNDLAQDIKVGVNAQSLVGLVFNTIGVSDGISMGTPGMRFSLPSRDVIADSVETVVQAMSYDGVVTVVGCDKNMPGALMAMLRLNRPSILVYGGTIAAGCHNDKELDVVSAFEAWGEKVAGKIDEKEFKSVIRNACPGAGACGGMYTANTMASAIEACGMALPYNASNPAVSKDKKEECLALGVHLRNLLELDLKPRDIVTRKALENALRLIAVLGGSTNAVLHFLAIAKAAQIDLTIDDFQKISDTTPFLADLKPSGKYLMKDLHQVGGVPAVLKYMLEQGMLHGDCMTVTGKTLAENLADVPSLKENQKVIRPIDQPIKATGHIRILKGNLATGGSVAKITGKEGLLFKGPARVFNGEYAANDGIREGKVKAGEVVVIRYEGPKGGPGMPEMLKPTAAIMGAGLGNSVALITDGRFSGGTHGFVVGHIVPEAQEGGAIGLVQDGDEITIDAEKNTISVALSDAELADRKAAWVKPPYKFKQGVLYKYIKSVATASEGCVTDSE

SEQ ID NO: 462 - DNA, 1677 bp, Flavobacteria bacterium
atggagctcaataaattcagcaaagcagttacacaagatccaacgcagccagcggcacaagccatgttgcatgcgattggaatgaccgatgaagactttaagaaaccattaattggtattgcttctacaggttacgaggggaatccctgtaacatgcatctaaacgatcttgcacaagatataaaagtgggtgtcaacgcacaatcattagtgggtttagtttttaataccattggtgttagcgacggtatttctatgggtactcctggaatgcgtttctctcttccttcacgagatgttattgctgattcagtagaaacagtggttcaagcaatgtcttatgatggcgttgtcactgttgtgggctgtgataaaaatatgccaggcgcactgatggcaatgttacgtttgaaccgtccctcgattttagtctatggaggtactattgctgctggatgtcacaatgataaagagttggatgttgtttctgcatttgaagcatggggcgaaaaagtagcagggaagattgatgaaaaagagtttaagagtgttatccgaaatgcctgccctggtgctggagcttgcggaggtatgtatactgccaacaccatggcttcagccatagaagcttgtggaatggcattgccctataacgcatccaatccagcagttagtaaagataagaaagaagagtgtcttgctttgggggttcatctcagaaaccttttggagcttgatttaaaacccagagatattgttactcgcaaagcattagaaaatgcgttaagattgattgctgttttgggaggttctacaaatgcagtacttcactttttagctattgccaaagcggctcaaatagacttgacaattgatgatttccaaaaaattagtgatacgactccctttttagctgatttgaaaccaagtggaaaatatttaatgaaagaccttcaccaggttgggggagtccctgccgtgttgaagtatatgttggaacagggtatgctccacggtgattgtatgaccgttactggaaaaacgttagctgaaaatttagccgatgttccaagtctgaaagaaaaccaaaaagtcattcgaccgattgaccaacccattaaagcgacaggacatattcgtattttaaaagggaacttagctacgggagggtctgtagcaaaaatcacaggaaaagaaggcttgttattcaaagggcctgcgcgagtttttaatggcgaatatgccgccaatgatggtatccgtgagggtaaggttaaagctggggaagtggtcgttattcgttatgaaggacctaaaggaggtcctggaatgcctgaaatgttaaagcctacagctgccattatgggagctggcttaggaaatagcgtcgctttgattaccgacggacgtttttcaggaggtacacatggatttgtagtaggacatattgtcccagaggcccaagagggaggtgccattggacttgttcaagatggagatgagatcaccatagatgcagaaaaaaatacaattagtgtggcattgtccgatgccgaactcgctgatagaaaagctgcatgggtaaagccaccttacaagtttaagcaaggggtattatataaatatattaaaagtgtagcaacagcttctgaaggttgtgttacggattccgagtaa

SEQ ID NO: 463 - protein, 563 aa, Nostoc azollae
MSENIKSKFITQGVQRSPNRAMLRAVGFQDADFNKAIVGIANGYSTITPCNMGINQLAQRAEMSLRNAGAMPQVFGTITISDGISMGTEGMKFSLVSREVIADSIETACTGQSMDGVLAIGGCDKNMPGAMLAIARMNIPAIFVYGGTIKPGHYDGKDLTVVSSFEAVGQHSAGKIDETELLEIERRACPGAGSCGGMFTANTMSSAFEAMGMSLPYSSTMAAEDAEKADSTEKSAFILVEAIRKQILPRQLITRKSIENAISVIMAVGGSTNAVLHFLAIARAAGVELTLDDFETIRARVPVLCDLKPSGRYVATDLHKAGGIPQVMKILLVRDLLHGDCLTISGQTVAEVLADIPAEPSPKQNVIRPWDRPIYAQGHLAILKGNLGTEGAVAKITGVKKPIITGPARVFESEESCLDAILAGKIKAGDVIIIRYEGPKGGPGMREMLAPTSAIIGAGLGDSVGLITDGRFSGGTYGMVVGHVAPEAAVGGNIALVEEGDSITIDANSRLLQVNISDAELASRRANWQPRPPRYTKGVLAKYAKLVSSSSVGAVTDLDLFGN

SEQ ID NO: 464 - DNA, 1692 bp, Nostoc azollae
atgtcagaaaatattaagagtaaatttatcacacaaggggtacagcgatcgcctaaccgggctatgttgcgggctgttggttttcaagatgcagacttcaacaaagccatagtcggtattgctaatggttacagtaccatcaccccctgtaatatggggattaaccaactagcacaaagggcagaaatgagcctcagaaatgcaggtgcaatgccccaagttttcggcacaattaccatcagtgatgggatttcaatgggaacagaggggatgaagttctctctggtgtcacgggaagtgatcgcagattccattgaaactgcatgtactggccaaagtatggatggtgttctggctattggtggttgtgacaaaaatatgccaggggcaatgttagcaatcgctcgcatgaatatccctgctatctttgtttatggtggcacaatcaaacccggacactacgatggcaaagatttaaccgttgttagttcctttgaagccgtcggccaacacagcgccggcaaaattgacgaaaccgaacttttagaaattgaacgccgtgcttgtcctggtgctgggtcctgtggtggaatgttcacagctaataccatgtcttcagcctttgaagcaatgggaatgagtttaccttattcctcaaccatggccgcagaagatgccgaaaaagcggatagcacagagaaatccgcctttatcttagtcgaagccatccgtaagcaaatattaccccggcaacttatcacccggaaatctatcgaaaatgccatatctgtaattatggccgttggtggttctaccaatgcagttttacattttttagcgatcgcccgcgcagctggtgtagaactaactttagacgactttgaaaccatccgggcccgtgttccagttttgtgcgatttaaaacccagtggtagatacgtagccacagacttgcataaagctggtggtattcctcaagtcatgaaaatcttattagttcgtgatttactgcatggtgactgtctaactatctctggtcaaactgtagccgaagtcttagcagacataccagcagaaccatcacccaagcaaaatgtaattcgtccttgggatcgtcccatctatgcacaaggacatttagctattctcaaaggtaacttaggtactgaaggtgcagttgctaaaattactggtgtgaaaaaacccatcatcaccgggccagcgagagtatttgaatcagaagaatcttgcttagatgcaattttagcaggtaagattaaagcaggtgatgtgatcatcatccgttacgaaggtccaaaaggtgggcctggtatgcgggaaatgttggctcccacctcagcaattattggtgcgggattaggtgattctgtgggcttaattacggatggacgcttttctggcggtacttatgggatggtagttggtcacgtcgctccagaagctgcagtcggcggtaatattgccttggtagaagaaggtgatagtatcaccattgatgctaattctcgattattacaagtgaatatatcggatgcagaattagctagtcgtcgtgctaactggcaaccgcgtccaccacgttatacaaaaggggtgctggcgaaatatgccaagttggtatcttctagtagtgttggtgctgttacagacttagatttgtttggtaattaa

SEQ ID NO: 465 - protein, 562 aa, Acidobacterium capsulatum
MSSEQNGSAKKNSVALTEGPNRAPARAMLRAIGFTRDDLRKPIIGIANTWTEIGPCNFHLRQIAEAVKQGIREAGGTPMEFNTVTISDGITMGTEGMKASLVSREVIADSIELVTRGNLFDGLVCIAGCDKNLPGTVMALARLDVPGLMLYGGSIAPGHLNGKDLTVQDVFEAVGSHAAGKLDDAGLEAVEANACPGAGACGGQFTANTMAMACEFMGISPMSISGVPAFLPEKLASAKEAGKLVLELAKRDLRPSQLITKESLENAIASVAASGGSTNAVLHFLAIAHERGIALSIDDFDRISEKTPLLCDMKPGGKYVAADYQKAGGSRLLAKRLIEGGYIHSDCLNASGRTLAEEAALAVEEPGQKVIFPATNALKPTGGLVILKGNLAPEGCVIKVAGHSRLTHRGPARVFDREQDAFAAVENGSIQPDDVMVIRYEGPKGGPGMREMLGVTAAIAGIPALSETVALLTDGRFSGATRGLMAGHVSPEAAVRGPIAAVRNGDMIHFDIPNRRLDVELTDAQIEERLKDWKEPAPHFSRGVFKKYVDTVSSAARGAVTN

SEQ ID NO: 466 - DNA, 1689 bp, Acidobacterium capsulatum
atgagcagcgaacagaacggatcggcgaagaagaacagtgtggccctcacggaagggccgaaccgcgccccggcgcgcgccatgttgcgcgcgattggctttacccgcgatgacctgcgcaagcccatcatcggcattgcgaatacgtggaccgagattggcccctgcaactttcacctgcggcagattgccgaggccgtgaagcaaggcattcgcgaagcgggcggcacgccgatggagttcaacacggtgacgatttcagacggcatcacgatgggcaccgaaggcatgaaggcctcgctggtgagccgcgaagtgattgccgactcgattgaactggtcacgcgcggcaacctttttgacggcctcgtctgcattgcgggctgtgacaagaatctgccgggcacggtgatggcgctggcgcggctcgatgtgccggggctgatgctgtatggcggctcgattgcgccaggacacctgaacggcaaggatctcacggtgcaggatgtattcgaggccgtgggctcccatgccgcaggtaagctggatgacgcgggcctggaggcagtggaagcgaatgcctgcccaggcgcgggcgcgtgcggcggacagttcacggcgaacacgatggcgatggcctgcgagttcatgggcatttcgccgatgtcgatctctggcgtgccggcgtttctgcccgagaagctggcgagtgcgaaagaagccggaaagctggtgctggagttggcgaagcgcgatctgcgcccgagccagttgatcacgaaggagtcgcttgaaaatgcaattgccagcgtggcggcttcgggcggttcgacgaatgcggtgctgcactttctggcgattgctcatgagcgcggcattgccctgtcgattgatgatttcgaccgcatcagcgagaagactcccctgctctgcgacatgaagccgggcggcaagtatgtggctgcggattaccagaaagcgggcggcagccggttgctggcgaagcgcctgatcgagggcggatacatccacagcgactgcctcaatgcgagcgggcgcacgctggccgaagaggctgcgctggccgtggaagagccgggacaaaaagtaatctttccagctacaaatgcgctgaaacccacgggcggcctggtgatcctcaagggcaatcttgctcctgaaggttgcgtgatcaaggtcgccgggcacagccgcctcacgcatcgtggaccagcgcgggtgtttgatcgcgagcaggatgcgtttgcggcggtagagaacggcagcattcagcccgatgacgtgatggtgattcgctatgaggggccgaagggtggtccgggcatgcgcgagatgctcggcgtgacggcggcgattgccggcattccggcactgagcgagacggtggctctgctgacggatgggcgcttctcgggcgcgacacgcgggttgatggcgggccatgtgtctcctgaagccgcggtgcgcgggccgattgcggcggtgcgcaatggcgacatgattcacttcgatattccaaaccgcaggctcgatgtggaactaacggacgcacaaattgaggaacgcctgaaggactggaaggaacctgcgccgcatttttcgcggggtgtgttcaagaagtatgtggatacggtgtcgtcggcggcgcggggcgcggtaacgaactag

SEQ ID NO: 467 - protein, 569 aa, Gemmatimonas aurantiaca
MSFPQLPSRHATSGPERAPHRAFYYAMGLTAEEIARPIVGVVSSWNEAAPCNIALKRQAEVAKRGVIAGGGTPREFTTITVTDGIAMGHAGMKASLVSRETIADSVELTVRGHCYDALVGIAGCDKSLPGLMLAMVRLDVPSIFLFGGSIMPGRYKDRDVTVLDVFEAVGSYAAGGITLDELTALEKVACPGAGACGGQYTANSMAYVSEAIGLALPGSASPPATYESRDAFAERSGQVVMDLVRSGLRPRQIVTRKSLENAAAVVAATGGSTNATLHLPAIAHEAGISFDLFDVAEVFKRTPLIADLKPGGKYLAKDVHDIGGVSIVLKSLLDGGFLHGDCITVTGKTLAENLADVVIPENQKVVMPVSQAISQTGGLVGLRGNLAPDGAVVKVAGLKHLTHSGPARVFDSEDDCFAAVMERRYTAGDVLVIRYEGPVGGPGMREMLSTTSAIYGQGLGETVALITDGRFSGATRGMCIGHVGPEAAMGGAIGLLRDGDIIDIDASAGTLSVRLTDEELVARRAEWTPRKTDFQSGAIWRYAQTVGPARNGAVVHPGGKAETHVYADA

SEQ ID NO: 468 - DNA, 1710 bp, Gemmatimonas aurantiaca
atgtcctttcctcagcttcccagccggcacgcgacgtccggccctgaacgtgcgccccatcgtgccttctactacgcgatgggactcacggcggaagagattgcgcgccccatcgtgggtgtggtgtcgagttggaacgaagcggcgccctgcaacatcgcgctcaagcggcaggccgaagtggccaagcgtggcgtgattgccggtggcggcacgccgcgggaattcaccaccatcacggtcaccgatggtatcgcgatgggacatgccggcatgaaagcgtcgctggtgagtcgtgaaaccatcgccgactcggtggaactcacggtgcgcgggcactgctatgatgcgctggtgggtatcgcgggctgtgacaagtcgctgccggggctcatgctggccatggtgcgtctcgatgtgccatcgatctttctgttcggcggttccatcatgccggggcgctacaaggaccgcgatgtcaccgtgctcgatgtgttcgaggcggtgggatcgtatgctgcaggcggcatcacgctcgacgaactcaccgcactcgaaaaggttgcgtgcccaggagccggagcgtgcggtggacagtacacggccaacagcatggcctacgtgtccgaagcgatcggactcgcacttccaggctcggcgagccctccggcgacgtatgagtcacgtgatgcctttgccgaacggtcgggccaggtggtgatggatctcgtgcgcagtggactgcgtccgcgtcagattgtcacgcgcaagtccctcgaaaatgccgcggcggttgtcgcggccacgggtggttccaccaatgccacgctgcacttgccggcgatcgcgcacgaagcgggcatttcgttcgacctgttcgatgtggccgaggtgttcaagcgcacgccgctgatcgccgatctcaagccgggtgggaaatatctggccaaggatgtgcacgacatcggtggtgtgagcatcgtgctcaagtcgctgctcgatggtggtttcctgcatggcgactgcatcacggtgaccggcaagacgttggccgagaatctggccgatgtggtgatcccggaaaatcagaaggtggtgatgccggtgtcgcaggccatctcgcagacgggcggtctggtgggattgcgtggcaacctggcgcccgatggtgccgtggtgaaggtggcaggactcaagcacctcacacacagtggcccggcgcgggtgttcgatagtgaagacgactgttttgcggccgtgatggaacggcgctataccgccggtgatgtgctggtgattcgctatgaaggaccggtgggtggtccgggtatgcgcgagatgttgtccaccacctcggcgatctacgggcagggactgggtgagactgtggccctcatcaccgatggccggttctcgggcgcgacccgtggcatgtgcatcggtcacgtcggacccgaggccgccatgggcggcgccatcgggttgctgcgcgatggcgatatcatcgacattgatgccagtgccggcaccttgtcggtacgactcaccgacgaggaactggtggcgcgccgcgcggagtggacgccgcgcaagaccgacttccagagtggggcaatctggcgatacgcacaaacggttggcccggcgcgcaatggtgcggtggtgcaccccggtggcaaagccgaaacgcacgtgtacgcggacgcgtga

SEQ ID NO: 469 - protein, 562 aa, Gemmatimonas aurantiaca
MTRRFRSATIYEGTVRATTHAFLEALGQSAEEIRRPHIGVFHTGGEMSPCNMNLRDQAQHAKTGIYAGGGMPHECPVVSVSDGLSIAHSGMRYSLVSRELIADSVEASTEGHQWDGIFAIGGCDKNLPGLMMGMLRCNVPSVFVHGGAALPGHWQGRDTNVAETYETIGKVYAGEATTEQLEAIAHACLPTAGSCAGQFTANTMGMVSEAIGLAPIGSSMVPAVFSERAPLMRRAAAALMRAVMADAPRPRDIVTRDALENACAVVSATGGSTNAALHIPAMAHEAGITFTLDDVAAVFRRTPLIADLQPGGKYLARDLHYAGGAGVVLRALLDAGALHGDCITFTGRTLAEELENAAPVDGRVVHAVEQALSADGGVTVLHGNLCPDGALLKTAGLGTLVHRGPARVFESEEAALVAVRDQLYAAGDVLVIRNEGPRGGPGMREMLGITALLYGQGMGAKVALLTDGRFSGATRGLCIGHAGPEAADGGPIAVLRDGDIITIDARPDARSIRVELSDEALAARLSALPAHQIPAHARGGLLQKYLKLVGPAHLGATTHSGL

SEQ ID NO: 470 - DNA, 1689 bp, Gemmatimonas aurantiaca
gtgacccgtcgattccgttcggccacgatctacgaaggcacggttcgcgccacgacacacgcatttctcgaggcgttggggcagagcgctgaagagatccggcgtccgcatatcggcgtgtttcacaccggtggcgagatgagtccgtgcaacatgaacctgcgcgaccaggcgcagcatgccaagacgggcatctacgccggcggtggcatgccgcacgaatgtccggtggtgtcggtgtccgatggcttgtccatcgcacacagcggcatgcgctactcgctggtgtcacgcgagctgattgccgacagtgtggaagccagcaccgaagggcatcagtgggacggcatcttcgcgattggcggctgcgacaagaacctgcccggcctcatgatgggcatgctgcgctgcaacgtgccatcggtgttcgtgcatgggggggccgcactgcccggacattggcagggacgtgacaccaacgtggccgagacgtatgagaccatcggcaaggtgtacgccggtgaagccacgaccgagcagctcgaagcgatcgcccatgcctgcctgccgacagcgggatcctgcgccggccagttcaccgccaacaccatgggcatggtgtcggaagccatcggactggcaccgattggttcgagcatggtgcccgcagtcttcagtgaacgtgccccgctcatgcgtcgcgccgcagcggcattgatgcgcgccgtgatggccgatgcaccgcgtccacgggatatcgtgacccgcgacgcgttggagaatgcctgcgcggtggtatcggcgaccggcggatccaccaacgccgcgctgcatatcccggcgatggcacatgaagccggtatcacgttcaccctcgatgatgtggccgcggtgtttcgtcgcacgccactcatcgccgatctgcagccgggcggtaaatacctggcgcgtgacctgcactacgccggcggcgctggtgtggtgttgcgtgcgctgctcgacgcaggcgctctgcacggtgattgcatcacgttcacaggacgtacgctggccgaagaactcgaaaacgccgcgccggtggacggacgtgtggtgcatgccgtggagcaggcattgtcggccgatggtggcgtgaccgtgctgcatggtaacctctgccccgatggcgccctgctcaagaccgccggcttgggcacactggtgcaccgtggaccggcacgggtgttcgagagtgaagaggcggcattggtcgcggtgcgcgaccagctctatgctgccggcgatgtgctggtgatccgcaacgaaggaccgcgcggcggtcccggcatgcgggagatgctgggcatcaccgccctgctgtacggtcagggcatgggcgccaaagtggcgctactcaccgatggccgtttcagcggcgccacccgaggcctgtgcatcggccacgccggacctgaggccgccgacggtggcccgatcgccgtgctgcgtgacggtgatatcatcaccatcgatgcgcggccggatgcacgcagcattcgcgtggaactcagcgatgaagcgctcgctgcacgactatcggcgcttcccgcccatcagatccctgcgcatgcgcgcggcgggctactgcagaagtacctgaagctggttggccccgcgcatctcggagcgaccacacacagcggcctgtaa

SEQ ID NO: 471 - protein, 564 aa, Rhodococcus erythropolis
MTEPDIKPRSRDVTDGLEKTAARGMLRAVGMGDDDWVKSQIGVASSWNEITPCNLSLDRLAKAVKEGVREAGGFPLEFGTISVSDGISMGHEGMHFSLVSREVIADSVETVMQAERLDGSVLLAGCDKSLPGMMMAAARLDLASVFLYAGSTLPGVAKLSDGSEREVTVIDAFEAVGACSRGLMSRADVDTIERAICPGEGACGGMYTANTMASAAEAMGMSLPGSASPPAPDRRRDGFARESGKAVVELLRRGITARDILTKEAFENAIAVVMAFGGSTNAVLHLLAIAHEAYVPLTLDDFARVGAKVPHLADVKPFGKHVMTDVDRIGGVPVIMKALLDAGLMHGDCLTVTGKTVAENLAHITPPDPDGKVLRAMNKPIHPTGGITILKGSLAPGGAVVKSAGFESDVFVGTARVFERERAAMDALEDGTITGGDVVVIRYEGPKGGPGMREMLAITGAIKGAGLGKDVLLLTDGRFSGGTTGLCVGHVAPEAVDGGPIAFVRDGDQIRLDVGTGQLELLVDDSELEARKKGWEPLPPRYTRGVLAKYSKLVGSASGGAVCG

SEQ ID NO: 472 - DNA, 1695 bp, Rhodococcus erythropolis
atgaccgaacccgacatcaagcccagaagtcgtgacgtcaccgacggactcgaaaagaccgcagcgcgcggcatgttgcgtgcagtaggaatgggtgacgacgactgggtcaagtcgcagatcggcgtcgcctcgtcctggaacgagatcacaccgtgcaacctgtccctcgatcgcctggccaaggccgtcaaggaaggtgtccgggaggccggtggattccccctcgaattcggcaccatctccgtttccgacggcatttcgatgggtcacgagggcatgcacttctccctcgtctcccgtgaagtgatcgcggacagcgtcgagaccgtcatgcaggccgagcgcctcgacggatcggttcttctcgccggctgcgacaagtcgttgcccggcatgatgatggcggcggcccgcctcgacctcgccagcgtgttcctgtacgccggttccaccctccccggcgtcgccaaactttccgacggcagcgagcgggaagtcaccgtcatcgacgcgttcgaggctgttggcgcctgctcgcgtggactgatgagccgcgccgacgtcgacaccatcgaacgggcgatctgcccgggcgaaggcgcgtgcggcggcatgtacaccgcaaacacgatggccagcgccgccgaggccatgggaatgtcgctgcccggcagcgcttcaccgcccgcaccggaccgtcgccgcgacggattcgcccgcgagagcggcaaagccgtggtcgaactcctgcgtcggggcatcaccgccagggacatcctcaccaaagaagcgttcgagaacgccatcgcagtagtcatggcgttcggcggatccaccaatgcggtgctccatctcctcgcgatcgcgcacgaagcgtacgtcccgctgacgctcgacgacttcgctcgcgtcggcgcgaaggtcccgcacctcgccgacgtcaagcccttcggaaagcacgtcatgacggacgtcgaccgtatcggcggcgtccccgtcatcatgaaagcattgctcgacgcgggactcatgcacggagattgcctgaccgtcaccggcaagactgttgcggagaacctggcgcacatcaccccgcccgatccggacggcaaggtcctgcgggcgatgaacaagcccattcacccgaccggaggcatcacgatcctgaagggctcgctcgctcccggcggcgcggtggtcaaatcggcaggattcgagtctgatgtattcgtcggcactgcacgggttttcgaacgtgaacgtgccgcaatggacgcgctcgaagacggaaccatcactggtggcgacgtcgtcgtcatccgctacgagggcccgaagggtggtcccggaatgcgcgagatgctggccatcacgggcgcgatcaagggtgcgggtctcggcaaggacgtcctgctgttgacggacggacgattctcgggcggcaccaccggcctgtgtgtcggacacgttgcgcccgaggccgtcgacggcggtcccatcgcgttcgttcgcgacggcgaccagatccggctcgacgtgggtaccggacaactcgaattgttggtcgacgactccgaattggaagcccgcaagaagggctgggagccgttgccgcctcgctacacacgtggtgtgttggccaagtactccaagctcgtgggatcagcctcgggtggagcagtgtgcggctga

SEQ ID NO: 473 - protein, 564 aa, Deinococcus deserti VCD115
MTDTAQKRKLNWNSHHITQGDERAPNRAMLRAVGFQDGDFEKPIIGVAHAQSNITPCNNGLGELADHITGAIHEGGGMPQIYGTITVSDGISMGTEGMKCSLVSREVIADSIETVSRGQSHDGVIVVGGCDKNMPGAMIGIARLNIPAIFVYGGTIKPGHYNGQDLTIVSVFEAVGAFGAGKISRHDFEQIEKRACPGNGSCGGMYTANTMSSAFEAMGMSLPHSSTMSAVDAEKAVSSADSARALLKLIEADIRPLDILTREAFENAITVIMAVGGSTNAVLHLMAVAHACNIDLTLADFERIRERTPVFCDLKPSGRYVATDLHEVGGIPRVMKMLLKEGLLHGDCLTVTGKTVAENLADEPDAPNADQDVIRPFDQPIYTQGHLAILRGNLAPNGSVAKISGLKQIKITGPARVFDSEEACMEAIMGDRIKAGDVLVIRYEGPKGGPGMREMLSPTSAIIGKGLGDSVGLITDGRFSGGTFGLVVGHVAPEAFVGGPIALVHEGDTIELNAETLNLTLHVPDEELARRRAEWSPPKPNYERGVLAKYAKLVSGAEVGAYTD

SEQ ID NO: 474 - DNA, 1695 bp, Deinococcus deserti
atgaccgacacggcacagaagcgcaagctgaactggaacagtcaccacatcacgcaaggcgacgagcgtgccccaaaccgcgcgatgctgcgcgctgtgggcttccaggatggtgatttcgaaaagccgattattggcgtggcgcacgcccagagcaacatcacgccgtgtaacaacggcctgggagagctagcagaccacatcaccggagctattcatgaagggggcggcatgccccagatctacggcaccatcacggtgtccgacggcatcagcatgggtactgagggcatgaagtgctcgctggtgagccgcgaggtgattgccgactccattgaaaccgtctcacgcggacagtctcatgacggcgtgattgtggtgggcggctgcgacaagaacatgccgggcgccatgatcggcattgcccggctgaacattccggccatcttcgtgtacggcggcaccatcaaacctggacactacaacgggcaggacctgactattgtcagcgtattcgaggcggtgggggcgttcggcgccggcaagatcagccggcacgatttcgagcagatcgaaaaacgtgcctgccccggcaacggctcgtgcggcgggatgtacaccgccaacaccatgagcagcgccttcgaggcgatgggcatgagcctgccgcactccagcaccatgagcgctgtggacgccgagaaggccgtcagcagcgccgacagtgcacgcgcgctgctgaaacttatcgaggcggatatccgcccactggacatcctgacccgcgaggctttcgagaacgccatcaccgtgatcatggccgtgggtggaagcaccaacgccgtcctgcacctgatggccgtggcgcacgcctgcaacattgacctgacgctggcagactttgagcgcatccgcgagcgcacaccggtcttctgtgatctcaagcccagcggacggtacgtggctaccgacctgcacgaggtaggcggcattccgcgcgtgatgaagatgctgctgaaagagggcctgctgcacggcgactgcctgactgtgaccggtaagacggtggcggaaaacctggcagatgagcctgatgcgccgaatgcagaccaggacgtcatccgtcccttcgaccagccgatctacacgcagggtcacctggcaatcctgcgcggaaacctggcgccgaatggcagcgtggccaagatcagcggcctgaagcagatcaagatcaccgggcccgcgcgggtattcgactcggaagaagcctgcatggaagccatcatgggcgaccgcatcaaagccggtgacgtgctggtcatccgctacgagggtcccaaaggcggccccggcatgcgcgagatgctctctccgacgagtgccatcatcggcaagggtctgggcgacagtgtcggcctgatcacggacggacgcttctccggaggaaccttcggcctggtggtcggccatgtcgcgccggaagcctttgtcggcggccctatcgcgctggtccacgagggcgacaccatcgaactgaacgccgagaccctcaacctcacgctgcacgtgccggatgaggaactggcccgccgccgcgccgaatggagcccgcccaagcccaactacgaacgcggagtcctggccaagtacgccaagctggtcagcggtgccgaggtcggcgcgtacaccgactga

SEQ ID NO: 475 - protein, 564 aa, Rhodococcus opacus
MNTPDPKPRSRDVTDGLEKTAARGMLRAVGMGDDDWGKSQIGVASSWNEITPCNLSLDRLAKAVKDGVHAAGGYPLEFGTISVSDGISMGHEGMHFSLVSREVIADSVETVMQAERLDGSVLLAGCDKSLPGMLMAAARLDLSSVFLYAGSILPGIAKLSDGTELDVTIIDAFEAVGACSRGLMSREDVDAIERAICPGEGACGGMYTANTMASAAEALGMSLPGSASPPATDRRRDGFARRSGEAVVELLRRGITARDILTKEAFENAIAVVMAFGGSTNAVLHLLAIASEAGVELNLGDFSRVGARVPHLADVKPFGKHVMKDVDHIGGVPVIMKALLDAGMLHGDCLTVTGRTMAENLADIAPPDPDGKVLRAMSSPIHPTGGITILEGSLAPGGAVVKSAGFDSDVFTGTARVFERERAAMDALEDGTITNGDVVVIRYEGPKGGPGMREMLAITGAIKGAGLGKDVLLLTDGRFSGGTTGLCVGHVAPEAVDGGPIAFVRDGDQIRLDVGTGTLELLVDEKELAGRKDGWEPLPPRYTRGVLAKYTKLVGSASGGAVCG

SEQ ID NO: 476 - DNA, 1695 bp, Rhodococcus opacus
atgaataccccggatccgaaaccccgcagccgcgacgtcaccgacggactggagaagaccgcggcacgcggcatgctccgtgcggtggggatgggcgacgacgactggggcaaatcccagatcggcgtggcctcctcctggaacgagatcaccccctgcaacctctcgctcgaccggctcgcgaaggccgtcaaggacggcgtccacgcggcgggcgggtatcccctcgagttcggcaccatctccgtgtccgacggcatctcgatgggacacgagggcatgcacttctccctcgtgtcgcgcgaagtgatcgccgacagtgtggaaacggtgatgcaggccgaacgcctcgacgggtcggtgctgctcgccggttgcgacaagtcgctgcccggcatgctgatggccgcggcccgcctcgacctgtcgagcgtgttcctctacgcggggtcgatcctgccgggcatcgccaaactgtccgacggcaccgaactcgacgtcaccatcatcgacgcgttcgaggcggtcggcgcgtgttcgcgcggactgatgagccgcgaggacgtcgacgccatcgagcgcgccatctgccccggcgagggtgcctgcggcggcatgtacaccgccaacacgatggccagtgccgccgaggcgctgggcatgtcgctgcccggcagcgcgtccccgccggccaccgaccgccgtcgcgacgggttcgcgaggcgcagcggcgaggccgtcgtcgaactcctccgccgcggcatcaccgcccgggacatcctcaccaaggaggcgttcgagaacgccatcgccgtggtcatggcgttcggcggttccaccaacgccgtcctgcacctgctggccatcgccagcgaagccggagtggaactgaacctcggcgacttctcccgcgtcggcgcccgcgtcccgcacctcgccgacgtcaagccgttcggcaagcacgtgatgaaggacgtcgaccacatcggcggcgtccccgtcatcatgaaggccctcctcgacgccgggatgctgcacggcgactgcctgaccgtcaccggccggacgatggccgagaacctcgccgacatcgcgccgcccgacccggacggcaaggtgctgcgcgcgatgagttcgccgatccacccgaccggcggcatcacgatcctcgagggttccctcgccccgggcggcgcggtggtgaagtccgccgggttcgactccgacgtcttcaccggcacggcccgcgtcttcgaacgcgagcgcgccgcgatggacgccctcgaggacggcaccatcacgaacggcgacgtcgtcgtcatccgttacgagggccccaagggcggtcccgggatgcgcgagatgctcgcgatcaccggcgccatcaagggggccggcctcggcaaggacgtcctgctcctcaccgacgggcgattctccggtggcaccaccggcctgtgcgtcgggcacgtggcgccggaggccgtcgacggcggtcccatcgcgttcgtccgcgacggcgatcagatccgcctggacgtcggaacgggcacgctggaactgctcgtcgacgagaaggaactggccggccgcaaggacgggtgggagccgctgcccccgcgctacacccgcggggtcctggccaagtacacgaagctcgtcggttcggcctcgggcggcgcggtctgcgggtag

SEQ ID NO: 477 - protein, 560 aa, Chryseobacterium gleum
MLNKYSKTFTQNSEQPAAKAMLYGIGFTEEDMHKAQVGIASMGYDGNTCNMHLNDLAQVVKKGTWNHGLAGLIFNTIGVSDGMSNGTDGMRYSLVSRDVIADSIEAICGAQYYDGLIALPGCDKNMPGTIIAMGRLDRPSIMVYGGTIAPGCYKGEALNIVSAFEALGKKIAGEITEEDFDGVVKNSCPGAGACGGMYTANTMASAIEALGMSLPYSSSNPALSKEKQEECLEAGKYLKVLLEKDIKPSDIMTRKAFENALRLIVILGGSTNAVLHFIAMAKSVGVPLTQDDFQKMSDHTPVLADLKPSGKYLMQDLHEHGGTPAVMKYLLEQGLLHGDCLTVTGKTVAENLADVPGLDFNTQKIIKPLSEPVKATGHLRILYGNLAEKGSVAKITGKEGERFVGKARVFDGEKNLIRGIQDGTVQHGDVIVIRHEGPKGAPGMPEMLKPTSALIGAGLGSSVALITDGRFSGGTHGFVVGHITPEAHEGGLIAFVHNDDLIEIDAVNNTIQLKVSEEEIERRKKGWQKPPLKVQKGLLYKYALTVSSAAEGCVTDEITQ

SEQ ID NO: 478 - DNA, 1683 bp, Chryseobacterium gleum
atgttaaataaatattcaaaaacattcacgcaaaacagtgaacagcccgccgccaaggccatgctatacgggataggatttacagaagaagatatgcacaaggctcaggtgggaattgccagtatgggctatgacgggaacacctgtaatatgcatctgaatgatcttgctcaggtagtaaaaaagggaacatggaaccacggattagccggattgatttttaataccatcggcgtaagtgacggaatgagcaacggaacagacggaatgcgctattccctggtaagccgtgatgtgattgcagacagtatcgaagcgatctgcggtgcacagtattacgacggactgattgctctgccaggctgcgacaaaaatatgcccggaaccataatcgcaatgggaaggctagacagaccctccattatggtgtacggaggaactattgcaccaggctgttacaaaggagaagcacttaacatcgtttctgctttcgaagcgttggggaaaaagattgcaggagaaatcactgaagaagatttcgacggtgtggtgaagaactcctgtcccggagctggagcatgtggtggaatgtataccgccaatacaatggcttctgctatagaggcattaggaatgagtcttccgtattcctcttccaatccggccttaagcaaagaaaagcaggaagaatgtcttgaggccggaaaatacctgaaagtacttctggaaaaagacattaaaccttccgatatcatgacccgtaaagcatttgaaaatgcacttcgccttattgttattttgggaggaagtacaaatgctgttctgcattttattgccatggcaaaaagtgtaggggttcctcttactcaggacgatttccagaagatgagcgatcatactccggtattggcagacctgaagccgagtggaaaatatctgatgcaggatctgcatgaacacggaggaaccccggcggtgatgaaatatttactggaacagggattactgcatggagactgccttaccgtcaccggaaaaacagtagccgaaaatctggcagatgttccggggttggattttaatactcagaaaattataaagccactttcagaacctgtaaaagctaccggacacctgagaatattgtacggaaaccttgcggaaaagggaagtgttgccaaaatcacaggaaaagaaggtgagcgctttgtagggaaagcccgtgtgtttgatggcgaaaaaaatctgatcagaggaattcaggatggaactgtacagcacggtgatgttattgtcatccgtcacgaaggcccgaaaggggcgcccggaatgccggaaatgctgaagcctacaagtgcattgatcggagccggtctgggaagcagtgttgctttaatcacggatggaagattcagtggaggaacccatggttttgttgtaggacacatcacaccggaagcccatgaaggaggtctgattgcttttgtacacaatgatgacctgatcgaaatagatgcggtaaacaataccatacagctcaaagtttcagaagaagaaatagaaagaagaaaaaaagggtggcaaaaacctccccttaaagtacagaaaggattgctttataaatatgcattaacagtatcatcagctgcagaaggctgtgtaacggacgaaatcactcaataa

SEQ ID NO: 479 - protein, 566 aa, Thermobaculum terrenum
MSDASTGFDPRHKSRTIVEGRERAGARSMLRAIGWTDEDFHKPVIGVAHCWIETMPCNYGHRELAEHVKRGIRDAGAVPVEVNTVAISDGITMGTEGMKASLISREVIADSIELVGRGHMFDAMVILVACDKTIPAGAMALARLDIPGFLIYTGTIYPGKYKGRDVNIQDVYEAIGAAAAGKITDEELTELEKVACPGIGACGGQYTANTMATVIEALGIAPVGSGSTPQPHPDKKRICYEAGKLVVDQLKRGLKPSDILTRQAFLNGIAAATGTGGSTNAVLHLLAIAREAGVELTIDDFNEISENTPVITDLRPSGKYTAVDVYEAGGIELILKRLIEGGKIDGSQLTPTGRTLAEEVANVQERKPGQQVILSLDNPKSPVGGLVILKGNLAPEGAVVKIAASGRTYHKGPARVFDCEEDAMDAVINKQINPGDVVVIRYEGPKGGPGMREMLGVTSAIVGEGLGDSVALLTDGRFSGATRGLMVGHVSPEAAVGGPIAALREGDIVTIDLDNKKLEVDLPQEVITARMQEWKAPAPRYTSGVFAKYAALVSSASEGAVTKAFL

SEQ ID NO: 480 - DNA, 1701 bp, Thermobaculum terrenum
atgagcgacgcatcgactggatttgatcctaggcacaaaagcagaaccatagttgaggggcgtgagagggcaggtgccagatccatgctacgggccataggatggaccgacgaggatttccataagcccgttataggagtagcacactgctggatagagacaatgccctgtaactatggtcatagagagctcgcagaacatgtcaagcgagggattagagatgccggagctgtgcctgtagaggtaaacaccgtcgctataagcgatggtatcactatgggcactgaaggtatgaaggcctccttgataagccgtgaggtgattgccgactccatagaactggtggggcgagggcatatgtttgatgccatggtcatccttgtggcttgtgataaaacaatcccagctggagctatggccctagcgaggttggatataccgggttttcttatttatacaggtactatctatccaggcaaatacaagggtagagatgtgaacatccaggatgtttatgaggccataggtgcggcggcagctggcaagattacggatgaagaacttaccgagcttgaaaaggtagcttgcccaggtattggtgcctgtggagggcaatacactgccaatactatggctacagttatagaagccctgggtatagcccctgttgggtctggatctacccctcaacctcatccggataagaagaggatttgctacgaagcaggtaaattggtggttgatcaactcaagagaggactaaagccgagcgatatactcaccaggcaagctttccttaacggcatcgctgctgctaccggaactggagggtctaccaatgcagtactacacctgttggctatagcgcgagaggcaggagtagagttgactatagatgacttcaatgagataagtgagaatactccagttatcactgacttgaggccgtctggtaagtacacagcggtcgatgtctatgaagctggtggtatagagttgatactgaagaggcttatcgaaggcggtaagatagatggtagtcagctaacacccacaggcagaacacttgccgaggaagtcgcaaacgttcaggagaggaaacctggccagcaagttatattgagccttgataatcctaagagtccagtgggcgggctagtgatactcaagggcaatctcgcacctgaaggcgcagtggtaaagatagctgcgagtggtaggacatatcataagggcccagcgagagtattcgactgtgaagaagatgccatggatgcagtaatcaacaagcagataaatcctggagatgttgtagtgattagatatgaagggccaaaaggtggtcctgggatgagggagatgctaggtgtcactagcgcgatagtaggtgaaggccttggagattcggtagcactccttactgatggaaggtttagtggggctactcgtggactgatggtgggacacgtttctcctgaggctgcagtaggtggtcctatagctgccctacgagagggagatatagtaaccatagaccttgataataagaaactggaggtagacctacctcaagaggtgatcacggctagaatgcaggagtggaaagcacctgcccctcgttacacatctggtgtgtttgccaagtatgcggctctagtatcttcagcctccgagggtgctgtaaccaaagcctttctctag

SEQ ID NO: 481 - protein, 562 aa, Kribbella flavida
MVTNSTPDIKPRSRTVTDGLEATASRGMLRAVGMGDDDWAKPQIGVASSWNEITPCNLSLDRLAKAVKDGVHAASGYPLEFGTISVSDGISMGHVGMHYSLVSREIIADSVETVMEAERLDGSVLLAGCDKSLPGMLMAAARLDLASVFLYAGSIMPGRLGDKDVTVIDAFEAVGACVRGLITREQVDAVERAICPGEGACGGMYTANTMAASAEALGMSLPGSAAPPAVDRRRDGYARRSGEAVVGLLRNGITARQILTKEAFENAIAVVMALGGSTNAVLHLLAIAREAEVDLSLADFNRIGDKVPHLGDLKPFGQYVMTDVDRVGGIPVVMRALLDAGLLHGDCLTVTGKTMAENLADIAPPDVDGVIIRALDRPIHGTGGITILHGSLAPEGAVVKSAGFDSDVFEGTARVFDGERGAMDAIEDGTMQAGDVVVIRYEGPKGGPGMREMLAVTGAIKGAGLGKDVLLLTDGRFSGGTTGLCVGHVAPEAVDGGPIAFVRDGDRITLDVKNRTLELHVDADELERRRQGWTPKEPAITRGVLGKYTRLVRSASEGAVCI

SEQ ID NO: 482 - DNA, 1689 bp, Kribbella flavida
atggtgacgaacagcactccggacatcaagccccgcagccgtacggtgaccgacgggctcgaggcaaccgcttcgcggggcatgctccgcgccgtcgggatgggcgacgacgactgggccaagccgcagatcggcgtcgcgtcgagctggaacgagatcaccccgtgcaacctgtcgctcgaccggctcgcgaaggcggtcaaggacggcgtgcacgcggcgagcggctacccgctggagttcggcacgatcagtgtctccgacggcatctcgatgggccacgtcggcatgcactactcgctggtcagccgggagatcatcgccgactcggtggagaccgtgatggaggccgagcggctcgacggctcggtgctgctggccggctgcgacaagtccctgcccggcatgctgatggccgccgcgcgcctcgacctggccagcgtcttcctgtacgccgggtcgatcatgcccggccggctcggcgacaaggacgtcacggtgatcgacgccttcgaggcggtcggcgcctgcgtgcgcggcctgatcacccgcgagcaggtcgacgccgtcgagcgcgcgatctgccccggcgagggcgcctgcggcggcatgtacaccgcgaacacgatggccgcctcggcggaggcgctcggcatgtccctgccgggttccgcggcgccgcccgctgtcgaccggcgccgcgacggctacgcccgccggtccggcgaggccgtcgtcggcctgctgcgcaacggcatcaccgcccggcaaatcctcaccaaggaagccttcgagaacgcgatcgccgtcgtgatggcgctcggcggctccaccaacgcggtcctgcacctgctggcgatcgcccgggaggccgaggtcgacctgagcctggccgacttcaaccggatcggcgacaaggtgccgcacctgggcgacctcaagccgttcgggcagtacgtgatgaccgacgtcgaccgggtcggcggcatcccggtggtgatgcgcgcgctgctggacgccggcctgctgcacggcgactgcctgaccgtgaccggcaagacgatggccgagaacctcgccgacatcgcgccgccggacgtcgacggcgtgatcatccgggcgctggaccggccgatccacggcaccggcggcatcaccatcctgcacggctcgctggcgccggagggcgcggtggtgaagagcgccggcttcgactccgacgtgttcgagggcaccgcgcgggtcttcgacggcgagcgcggcgcgatggacgcgatcgaggacggcaccatgcaggccggcgacgtggtggtgatccgctacgagggcccgaagggcggtccgggcatgcgcgagatgctcgcggtgaccggcgcgatcaagggcgccggcctcggcaaggacgtcctgctgctcaccgacggccgcttctccggcggtacgacgggcctgtgcgtcggccacgtcgcgccggaagccgtcgacggcgggccgatcgccttcgtgcgcgacggcgaccggatcacgctggacgtgaagaaccggaccctggagctgcacgtcgacgccgacgagctggagcgccgccgccagggctggacgccgaaggagccggccatcacccgcggagtgctcggcaagtacacccggctggtgcggtcggcctcggaaggcgccgtttgcatctga

SEQ ID NO: 483 - protein, 573 aa, Gordonia bronchialis
MSPSPESSTTNDVDIKPRSRDVTDGLERTAARGMLRAVGMGDDDWAKPQIGIGSSWNEITPCNLSLDRLATSVKEGVFAAGGYPLEFGTISVSDGISMGHEGMHFSLVSREVIADSVETVMSAERLDGSVLLAGCDKSLPGMLMAAARLDLANVFLYAGSTLPGYATLSDGSERQVTIIDAFEAVGACSRGLMSRADVDTIERAICPGEGACGGMYTANTMASVAEALGMSLPGSAAPPAPDRRRDQFARRSGEAVVELLRCGITARDIMTFEAFENAIAVVMAFGGSTNAVLHLLAIAHEADVALSLADFSRIGSCVPHLADVKPFGQHVMTDVDRIGGVPVVMKALLDAGLLNGDCLTVTGKTMAENLADIAPPDPDGKVLRAMTTPIHPTGGITILTGSLAPGGAVVKSAGFDSDVFEGVARVFDRERAAMDALEDGTITAGDVVVIRYEGPKGGPGMREMLAITGAIKGAGLGKDVLLMTDGRFSGGTTGLCVGHIAPEAVDGGPIALVRDGDRIRLDVASGTLDILVDEDEMASRAKGFTPLLPRYTRGVLAKYAKLVTSASRGAICE

SEQ ID NO: 484 - DNA, 1722 bp, Gordonia bronchialis
atgagcccctcacctgagtcctcgaccaccaacgacgtggacatcaagccccgcagccgagacgtcaccgacggcctcgaacggaccgcggcacgcggcatgctccgcgcggtcggcatgggtgacgacgactgggccaaaccgcagatcgggatcgggtcgtcgtggaacgagatcaccccctgcaacctgtcgctggaccggctggccacctcggtcaaggaaggtgtcttcgccgccggtggctaccctctcgaattcggcaccatctcggtgtccgacggcatctcgatgggacacgagggtatgcatttctcgctggtctcgcgcgaggtgatcgccgacagcgtcgagacggtcatgagtgccgaacggctcgacgggtcggtgctgctcgccggttgtgacaagtcgctgcccggaatgctgatggcggccgcccggctcgatcttgcgaatgtgttcctctacgccggctcgacgctgcccggctatgccacgctgtccgacggctcggagcggcaggtcaccatcatcgacgccttcgaggcggtcggggcgtgctcgcgcgggctgatgagcagagccgacgtggataccatcgaacgcgccatctgtcccggtgagggcgcctgcggtggcatgtacacggccaacacgatggccagcgtcgccgaggcgctgggcatgtcgctgccgggtagtgcggcgccgcccgccccggaccggcgacgcgaccagttcgcgcgccgcagcggcgaggccgtcgtcgaactcctgcgttgcggcatcaccgcgcgcgacatcatgaccttcgaggcgttcgagaacgcgatcgcggtggtcatggccttcggcggatcgaccaacgccgtgctgcatctgctggccatcgcccacgaggccgacgtcgcgctcagcctggccgacttctcccgaatcggttcgtgcgtaccgcatctggccgatgtcaagccgttcggtcagcacgtgatgaccgatgtggaccggatcggtggcgtgccggtggtgatgaaggcgctgctcgacgcgggcctgctcaacggcgactgcctcaccgtcaccggcaagacgatggcggagaatctagccgacatcgcgccgccggacccggacggaaaagtgttgcgcgccatgacaacaccgatccaccccaccgggggtatcaccatcctgaccggttcgctcgcgccgggcggtgcggtggtgaagtcggccggcttcgactccgacgtcttcgaaggtgtggcgcgcgtgttcgaccgggagcgtgccgcgatggacgccctcgaggacggcaccatcaccgccggtgacgtggtggtcatcaggtacgaggggcccaagggcggtccgggtatgcgcgagatgcttgccatcaccggcgccatcaagggtgcgggtctcggcaaggacgtgctgctgatgaccgacggccggttctccggcggcaccaccggcctgtgcgtgggtcacatcgcgcccgaggccgtcgacggcgggccgatcgccctggtacgcgacggcgaccggattcgcctcgacgtggcgtcgggcacgctcgacatcctcgtcgacgaagatgagatggcttctcgggcaaagggattcaccccgcttctgccccggtacacgcggggtgtgctggcgaagtacgccaaactcgtcacctccgcatctcgcggagcgatctgcgaatga

SEQ ID NO: 485 - protein, 575 aa, Geodermatophilus obscurus
MTIGEDLIPGRDSHSGTHSPLKPRSYEVTDGIAKAPARAMLRAVGMGDDDWEKPQIGVASSWNEITPCNLSLDRLAKRAKEGVHAAGGYPLEFGTISVSDGISMGHEGMRASLVSREVIADSVETVVFAERLDGTVLLAGCDKSLPGMLMAAARLDLASVFVYSGSILPGRLGDRDNLTIIDVFEGVGACARGLISREELDAIEKAACPSEGSCGGMYTANTMASVAEALGMALPGSAAPPAPDSRRDAVAIASGEAVVNLLRQGITARQIMTREAFENAITVVMALGGSTNAVLHLLAIAHEAQVELTLEDFNRIGDRTPHLADVKPFGRFVMTDIDRVGGVPVVLRALLDAGLLHGDVLTVTGKTMAENLAEIAPPDLDGTIVHAMDNPIHKTGGLTILRGSLSPDGAVVKSAGFDADVFEGTARVFDGEQGAMDAVTEGTLQAGDVVVIRYEGPRGGPGMREMLAVTGAIKGAGLGKDVLLLTDGRFSGGTTGLCVGHVAPEATDGGPIALVQDGDRIRLDLTTRTLDLLVDDDELARRRQDWQPLPPRYTTGVLGKYAKLVSSAAQGAVCG

SEQ ID NO: 486 - DNA, 1728 bp, Geodermatophilus obscurus
gtgacgatcggcgaggacctcatccccgggcgcgactcccacagcgggacgcacagcccgctcaagccgcgcagctacgaggtgaccgacggcatcgccaaggccccggcgcgggcgatgctgcgtgcggtgggcatgggcgacgacgactgggagaagccgcagatcggcgtcgcctcgtcgtggaacgagatcaccccgtgcaacctctcgctggaccggctggccaagcgggccaaggagggcgtgcacgccgccggcggctacccgctggagttcggcaccatctccgtctccgacggcatctcgatgggccacgagggcatgcgggcctcgctggtctcccgcgaggtcatcgccgactcggtcgagacggtcgtgttcgccgagcgcctcgacggcacggtgctgctcgccggctgcgacaagtccctgcccggcatgctcatggccgcggcccgcctcgacctcgccagtgtcttcgtctactccggctcgatcctgcccggacggctcggtgaccgggacaacctgacgatcatcgacgtcttcgagggcgtcggggcctgcgcccgcgggctgatcagccgtgaggagctggacgccatcgagaaggcggcctgccccagcgagggctcctgcggcggcatgtacaccgccaacacgatggccagcgtcgccgaggcgctggggatggcgctgcccggcagcgccgcgccgccggcgccggacagccgccgcgacgccgtggcgatcgcctccggcgaggccgtggtcaacctgctgcgccaggggatcaccgcccggcagatcatgacccgggaggcgttcgagaacgccatcaccgtcgtcatggcgctggggggctcgaccaacgccgtcctgcacctgctggccatcgcgcacgaggcccaggtcgagctcacgctcgaggacttcaaccggatcggcgaccgcaccccgcacctggccgacgtcaagcccttcggccggttcgtcatgaccgacatcgaccgtgtcggcggcgtcccggtcgtgctgcgcgcgctgctcgacgccggcctgctgcacggcgacgtcctgaccgtgaccgggaagacgatggccgagaacctcgccgagatcgccccgcccgacctggacggcacgatcgtccacgccatggacaacccgatccacaagaccggcggcctgaccatcctgcgcggctcgctgtccccggacggcgcggtcgtgaagtcggccggcttcgacgccgacgtcttcgagggcaccgcgcgcgtcttcgacggcgagcagggcgccatggacgccgtcaccgagggcacgctgcaggcgggcgacgtcgtggtgatccgctacgagggtccccggggcgggccgggcatgcgcgagatgctcgccgtcaccggcgccatcaagggggcgggcctgggcaaggacgtcctgctgctcaccgacggccggttctccggcgggacgacgggcctgtgcgtcggccacgtcgcgcccgaggccaccgacggcggcccgatcgccctcgtgcaggacggcgaccgcatccggctggacctcaccacccgcaccctcgacctgctggtcgacgacgacgagctggcccgccgccggcaggactggcagccgctgcccccgcgctacaccaccggcgtcctcggcaagtacgccaagctggtgagctccgcggcccagggcgccgtctgcggctga

SEQ ID NO: 487 - protein, 570 aa, Xylanimonas cellulosilytica
MVSDDGGGRSLKPRSWQVTDGLEATAARGMLRAVGLGDEDFAKPQIGVASSWNEITPCNLSLDRLAQACKSGVHAAGGYPLEFGTISVSDGISMGHEGMHFSLVSRDVIADSVEVVMSAERLDGSVLLAGCDKSLPGMLMAAARLDLASVFLYAGSIMPGWVKLSDGTEKEVTIIDAFEAVGACARGLMSEDDVGRIERAICPGEGACGGMYTANTMASAAEALGMSLPGSAAPPSADRRRDAWALRSGEAVVGLLRAGITARDILTKEAFENAIAVVMAFGGSTNAVLHLLAIAHEADVDLTLADFDRVADRVPHLGDLKPFGRYVMNDVDRVGGVPVVMKALLDAGLLHGDALTVTGRTVAENLAAIDPPDPDGKILRAVADPIRATGGITILHGSLAPDGAVVKSAGFESDVFEGTARVFERERAALDALEDGTIVAGDVVVIRYEGPKGGPGMREMLAITGAIKGAGLGKDVLLVTDGRFSGGTTGLCVGHIAPEAVDGGPVAFVRDGDRVRLDVRAKTLDLLVEPGTLAARRAEGWAPLQHGYTRGVLAKYTKLVQSASRGAVLE

SEQ ID NO: 488 - DNA, 1713 bp, Xylanimonas cellulosilytica
atggtgtccgacgacggtggggggcgatcgctgaagccgcggtcgtggcaggtgaccgacgggttggaggcgacggcggctcgcgggatgctgcgtgccgtcgggctcggggacgaggacttcgccaaaccgcagatcggggtcgcgtcgtcgtggaacgagatcacgccctgcaacctgtcgctcgaccggctcgcgcaggcgtgcaagtcgggcgtgcacgcggccggcgggtacccgctcgagttcgggacgatttcggtgtccgacgggatctcgatggggcacgagggcatgcacttctcgctcgtgtcgcgcgacgtcatcgcggactcggtcgaggtggtgatgtcggccgagcggctcgacgggtcggtgctgctcgcgggatgcgacaagtcgctgcccgggatgctcatggccgcggcgcggctcgacctggccagcgtgttcctctacgccggctcgatcatgcccggctgggtcaagctctcggacggcaccgagaaggaagtcaccatcatcgacgccttcgaggcggtcggggcgtgcgcgcgcggcctgatgagcgaggacgacgtcgggcgcatcgagcgggccatctgccccggcgagggtgcctgcggcggcatgtacaccgccaacacgatggcctcggccgcggaggcgctcgggatgtccctgcccggctcggcggcaccgccgtcggccgaccggcgtcgcgacgcgtgggcgctgcggtcgggggaggccgtcgtcgggctgctgcgggccgggatcaccgcccgcgacatcctcacgaaggaggcgttcgagaacgccatcgccgtcgtcatggcgttcggcgggtccacgaacgcggtgctgcacctgctcgccatcgcgcacgaggccgacgtcgacctgacgctcgccgacttcgaccgggtcgcggaccgggtaccgcacctgggagacctcaagcccttcgggcggtacgtcatgaacgacgtcgaccgcgtcggcggggtgccggtcgtgatgaaagcgctgctcgacgccgggctgctgcacggggacgcgctgaccgtcaccggccgcacggtggccgagaacctcgcggcgatcgacccgcccgacccggacggcaagatcctgcgggccgtggccgacccgatccgggcgaccggtggtatcaccatcctgcacgggtcgctcgccccggacggcgccgtcgtgaagtcggccgggttcgagtccgacgtgttcgagggcacggcccgggtcttcgagcgggagcgggccgcgctcgacgcgctcgaggacggcaccatcgtggccggtgacgtcgtcgtcatccggtacgaaggaccgaagggcgggcccggcatgcgcgagatgctcgccatcaccggggcgatcaagggcgccgggctcggcaaggacgtgctgctggtcaccgatgggcggttctcgggcgggacgaccgggctgtgcgtgggacacatcgcccccgaggccgtcgacggcggcccggtcgcgttcgtgcgcgacggcgaccgggtgcggctcgacgtgcgcgccaagacgctcgacctgctcgtcgagccggggacgctcgccgcccgacgggcggagggctgggcgccgctgcagcacggctacacccgcggggtgctcgccaagtacacgaagctggtccagtcggcctcgcgcggcgcggtcctcgagtag

SEQ ID NO: 489 - protein, 566 aa, Sphingobacterium spiritivorum
MKSSSNGENQMNKYSRTFTQDETQPAAKAMLYGIGLTDADMDKAQVGIASMGYDGNTCNMHLNDLAQVVKKGVWESELVGLTFGTIGVSDGMSNGTEGMRYSLVSRDVIADSIETICGGQYYDGLIAIPGCDKNMPGAVIAMGRLNRPSIMVYGGTIAPGHYKGEELNIVSAFEALGQKICGNLSDEDYEGIIKHTCPGAGACGGMYTANTMASAIEALGMSLPYSSSNPAVSSDKKDECLQAGKYIRTLLEKDIKPSDIMTRKAFENALRAIVILGGSTNAVLHFIAIGKAVGVDITQDDFQRMSDETPVLADFKPSGKYLMQDLHQYGGTPAVLKYLLDEGLLHGDCLTVTGKTLAENLADVKSIMDYDQKIIQPLSNPIKPSGHLQILYGNLAEKGSVAKISGKEGEKFTGPARVFDGEQNLIRGIQDGTVKKGDVVVIINEGPVGAPGMPEMLKPTSAIIGAGLGKSVALITDGRFSGGTHGFVVGHITPEAYQGGLIGLVENDDIIEIDAVNNTINLKVDDATIAKRREKWVQPSLKVSKGVLYKYAKTVSDASEGCVTDQ

SEQ ID NO: 490 - DNA, 1701 bp, Sphingobacterium spiritivorum
atgaagtcatcatctaacggcgagaatcaaatgaataaatacagccgtacgtttacacaagacgaaacacaacccgcagccaaagccatgctatacggaatcggtcttaccgatgcagatatggataaggctcaggtcggtattgcaagcatgggatatgatgggaatacatgtaatatgcacctgaatgatctggcacaagtggtcaaaaaaggtgtgtgggaaagcgaattggtaggcttgacttttggaacaataggtgtgagtgacggaatgagtaatggtacagaaggtatgcgctactcgttggtaagtcgtgatgtcatagccgacagcatagaaacaatctgtggcggacagtactatgacggattgattgccatcccgggttgcgacaagaacatgccgggcgctgtcatcgctatgggtcgcctgaatcgtccttctataatggtatacggaggtacaatagcgccgggacattataaaggagaagaactgaatattgtatcggcttttgaagcattaggacaaaaaatctgtggtaacctgtccgatgaagactacgaaggaatcatcaagcatacctgtccgggagcaggagcctgcggtggcatgtacactgcaaatacaatggcatctgcgattgaggccttagggatgagcctaccttattcatcttctaatccggcagtatcttcagataaaaaagacgaatgtcttcaggcaggtaaatacattcgtacactgttggaaaaagatatcaagccgtcagatatcatgacacgtaaagcctttgaaaatgcccttagagcaattgtaattttaggcggcagcacaaatgcggtattacactttatcgcaatcggaaaagctgtaggagtcgatatcacacaggatgactttcaacgcatgagtgatgaaactcctgtactggcggatttcaaaccgtcaggaaaatatctgatgcaggatctgcatcaatatggaggtacgcctgcagtattgaaatatttactggatgaggggttattacacggagattgtctgactgttactgggaaaacattagcagagaatcttgcagacgtaaaatccatcatggactatgatcaaaagatcattcagccattgagcaatccgatcaaaccaagcggtcaccttcagattctatacggcaatctggcagaaaaaggttctgtagccaagatttcaggtaaagaaggtgagaaattcaccggtcctgcccgcgtttttgacggagagcagaacctgatccgcggaattcaggatggtactgtaaaaaaaggtgatgtagtcgttatcatcaacgaaggtcccgtaggagctccgggtatgccggaaatgttaaagcctacatccgctattatcggagcaggactcggaaaatcagtagccctgattacagacggccgcttctccggaggtacacacggatttgtagtcggacacattactccggaagcctatcagggtggtctgatcggattagtagaaaatgacgatatcattgagatcgatgcggtcaataataccatcaatctgaaagtagacgatgccacaatagccaagcgtagagaaaaatgggtacagccgtcattgaaagtatctaaaggtgttctttacaaatacgcaaaaacagtttcggatgcgtccgaaggttgtgttacagatcagtaa

SEQ ID NO: 491 - protein, 554 aa, Meiothermus silvanus
MRSDVIKQGPQQAPARAMLRAVGVTDDDFKIPWIGIVNTWTEGMPCNFHLRELAADLKVGAKEAGLHAFEFGAPAISDGISMGTIGMRASLISREVIADSIELIARGYLYDGMVALVACDKTNPGGMMGVIRADVPSLVLYGGSIAPGILRDKKQTVVSVFEAVGQYAAGKITEQELAEVERTAIPGPGACGGQYTANTMAMVLEVMGFSPIGYNAIPAIAPHKKAAGRKAMHILAEAIRENRTPKSFLTRQSFVNAIAAVAATGGSTNAVLHLLAIAREAGVKLELDDFDTISRKTPVIADMRPWGTYTAWELWEAGGIPLIIRRLIEGEMIDGSQMTITGKTLWEEVKDAAETPGQQVVVPREKAFKPEGGLRILKGSLAPEGAVLKLAGTERKQFRGPARVFDGEQKAMKAVLAKEIQPGDVVVIRYEGPKGAPGMPEMLSVTSALVGEGLGPDVALVTDGRFSGGTKGLMIGHVAPEAQVGGPIALVEEGDLISIDCDAGRLELEVSPEVLEARRAKWKAPEPHYKSGLFARYAKLVSSAKYGAVLEQAE

SEQ ID NO: 492 - DNA, 1665 bp, Meiothermus silvanus
atgcgctcggatgtgatcaaacaaggcccgcagcaagctcctgcgcgtgcgatgttgcgtgcggtgggggtaacggacgacgacttcaagattccttggataggcatcgtcaacacctggaccgaagggatgccctgcaatttccacctacgcgagttagccgccgacctcaaggtaggggctaaagaggctgggctgcatgccttcgagttcggcgccccggccatttccgacgggatcagcatgggcaccatagggatgcgggcttcgctcatcagccgcgaggtaatcgccgactccatcgaactcatcgcccggggctacctctacgacggaatggtagcgctagtagcctgcgacaagaccaaccccggcgggatgatgggggtgattcgcgccgacgtaccgagcctagtgctctatggtggctccattgcccccggtatcctgcgcgacaaaaagcagaccgtggtctcggttttcgaggcagtggggcagtacgcagcaggcaaaattactgaacaagagctggccgaggtcgaacgcaccgccatccccggccctggggcctgcggggggcagtacacggcaaataccatggccatggtgctggaggtgatgggcttctcccctatcggctacaacgctatccctgccattgccccccacaagaaagccgccggacgaaaggcgatgcacatcctggccgaggccatccgggagaaccgcacgcccaagagcttcctcacccggcagtccttcgtcaacgcgatcgccgcagtagccgccacgggcggctcgaccaacgcggtcttgcacctcctggcgatcgcccgcgaggcgggggtcaagctcgagctggacgacttcgacaccatctcccgcaagaccccggtgatcgccgacatgcgcccctggggcacctacaccgcctgggagctgtgggaagccgggggcatcccgctcatcatccgccgcctgatcgaaggggagatgatcgacggcagccagatgaccataaccggcaagaccctttgggaagaggtcaaggacgccgccgagaccccgggacagcaggtggtggtcccgcgggagaaagccttcaagcccgagggagggctacgcattctgaagggctcattggcccccgaaggggcggtcttgaagctcgccggaaccgagcgcaagcagttccgcggcccggcccgggtcttcgacggcgagcaaaaggccatgaaagcggtgctggccaaagagatccagcccggggatgtggtggtgatccgctacgagggccccaagggagcccccggaatgcccgaaatgctctcggtgacgagtgctttagtgggcgaggggctcggcccggacgtagcgttggtaaccgacggacgctttagcggcggaaccaagggcctgatgatcgggcacgtcgcgccggaagcccaggttggcggtccgattgcgctcgtcgaagagggggacctcatctcgattgactgcgacgcggggaggctcgagctggaggtctcccccgaggtgttggaagcgcgcagggctaagtggaaggcccctgagccgcattacaagagcgggctgtttgcccggtacgccaaactggtgagcagtgcgaagtatggggcagtgctcgagcaagccgagtaa

SEQ ID NO: 493 - protein, 554 aa, Meiothermus ruber
MRSDIIKKGPQQAPARAMLRAVGIGDEEFKIPWVGIVNTWTEGMPCNFHLRDLAADLKIGAREAGFQTFEFGAPAISDGISMGTVGMRASLVSREVIADSIELIAQGYLYDGMVALVACDKTNPGAMMGVIRANVPSLVLYGGSIAPGLLRGKKQTVVSVFEAVGQYAAGQITEEELAEIERTAIPGPGACGGQYTANTMAMILEVMGFSPIGYNAIPAVAPEKKEAGRRAMRILAEAIQAGRTPKSFLTKKSFTNAITAVAATGGSTNAVLHLLAIAREAGIKLTLEEFDKISRKTPVIADMRPWGQYTAWELWEAGGIPLVIRRLIEGGLIDGDQMTVSGKTLWQEVKNARETKGQQVVTSVKKPFKPEGGLRVLKGSLAPDGAVLKLAGTETKVHRGPARVFDGEQSAMKAVLKKQIKPGDVVVIRYEGPKGAPGMPEMLSVTSALVGEGLGPYVALVTDGRFSGGTKGLMIGHVAPEAQVGGPIALVEEGDIISIDCDRGILNLEVSEKELARRAKAWKPPKPHYKSGLFARYAALVSSAREGAVLLKPE

SEQ ID NO: 494 - DNA, 1665 bp, Meiothermus ruber
atgcgttcggacatcatcaaaaaaggccctcaacaagcccccgcccgggctatgctgcgcgcggtgggcatcggcgacgaagagttcaagattccctgggtgggcatcgtgaacacctggaccgaggggatgccctgcaactttcacctgcgcgacctggccgccgacctgaagattggggccagggaggctggcttccagacctttgagtttggggccccggccatctccgacggcatcagcatgggcacggtgggtatgcgggcctcgctggtgagccgcgaggtgatcgccgactcgattgaactgattgcccagggctacctctacgacggcatggtggccctggtggcctgcgacaagaccaaccctggggccatgatgggggtgatccgggccaacgtgcccagcctggtgctgtacggcggctccattgcccccggcctcctgcgcggcaaaaagcagaccgtggtctcggtctttgaggcggtggggcagtacgcggccggccagattaccgaggaagagctggccgagatcgagcgcaccgccattcccggccccggtgcttgcggcgggcagtacaccgccaacaccatggccatgatcctcgaggtgatgggcttctcgcccatcggctacaacgccatcccggccgtcgcccccgagaaaaaagaggccgggcggcgggccatgcgcatcctggccgaggccatccaggcgggccgcacccccaagagcttcctgaccaaaaagagcttcaccaatgcgattaccgcggtggcggccaccggcggctcgaccaatgcggtgctgcacctgctggccatcgccagggaggccgggattaaactgacgctcgaggagttcgataaaatctcgcgtaaaaccccggtgattgccgatatgcgcccctggggtcagtacaccgcctgggagctctgggaggctgggggcatcccgctggtgattcgccgcctgattgaaggcggcctgattgacggcgaccagatgaccgtgagcgggaaaaccctctggcaggaggttaaaaacgccagagagaccaagggccagcaggtggttaccagcgtcaaaaaacccttcaaacccgaagggggcctgcgggtgctcaagggttcgctggccccggacggcgcggtgctcaagctggccggcaccgagaccaaggtacaccgggggccggcccgggttttcgacggcgaacagagcgccatgaaggccgtcctcaaaaaacagatcaagcccggtgatgtggtggtgatccgctacgaaggccccaagggggcccccgggatgcccgagatgctctcggtgacctcggccctggtgggcgagggactggggccgtatgtggccctggtgaccgatgggcgtttcagcggtggcaccaagggcctgatgatcgggcatgtggcccctgaggcccaggtgggcgggcccatcgcgctggtcgaggagggcgacatcatctcgattgactgcgaccggggtatcctgaacctggaggtctcggaaaaggagctggcccggcgggccaaagcctggaagccccccaagccccactacaaaagcgggctgtttgcgcgctacgcagcgctggtgagcagtgcacgggagggggcggtcttattgaagcccgagtaa

SEQ ID NO: 495 - protein, 567 aa, Nakamurella multipartita
MSETAADAAGKQHRKPHSHIVTDGIERAPARGMLRAVGMGDDDWRKPQIGVASSWNEITPCNMSLDRLAKAAKQGVHEADGYPLEFGTISVSDGISMGHGGMHYSLVSREVIADSVETVFRAEQLDGGVLLAGCDKSEPGMLMAAARLDIAAVFLYAGSTLPGQLDGETVTIIDAFEGVGACLAGKISRERLTEIEKAICPGEGACGGMYTANTMASVAEALGMSLPGSAAPPAPDARRDTYAIRSGQAVVALIDAGITSRDILTKKAFENAITVLMALGGSTNAVLHLMAIAHEAKVDLALEDFNRIGERTPHLADVKPFGRYVMTDVDRIGGVPVVMKALLDAGLLHGDTLTVTGKTMAENLAELNPPELDGDVLRKLSNPIHTTGGITILHGSLAPEGAVIKSAGIEYAEFTGPARVFDGEAGVLEAVTNGTLGKGDVIVIRWEGPKGGPGMREMLAVTGAIKGAGLGKDVLLLTDGRFSGGTTGPCIGHIAPEAAHGGPIALVQEGDQIRLDLAAKTLDLLVDEAELERRRADWEPREQNLNFGVAGKYAKLVGSAAKGAVCF

SEQ ID NO: 496 - DNA, 1704 bp, Nakamurella multipartita
atgagcgagaccgccgccgacgccgcaggaaagcagcaccgcaagccgcacagccacatcgtcaccgacggcatcgagcgggctccggcccgcggcatgctgcgggcggtgggcatgggcgacgacgactggcgcaagccgcagatcggcgtcgccagttcctggaacgagatcaccccgtgcaacatgtccctggaccggctggccaaggcggccaagcagggcgtgcacgaggccgacggctacccgctggagttcggcaccatctcggtgtccgacggcatctccatgggccacggcggcatgcactactcgctggtcagccgtgaggtcatcgccgactcggtggagacggtcttccgggccgagcagctcgacggcggggtgctgctggccggctgcgacaagtccgagcccggcatgctgatggccgcggcccgcctggacatcgcggccgtgttcctctacgccggctcgaccctgcccggtcagctcgacggcgagaccgtcaccatcatcgacgccttcgaaggcgtcggcgcctgcctggccggcaagatcagccgggagcggctgaccgagatcgagaaggccatctgtccgggcgagggcgcctgcggcggcatgtacacggccaacacgatggccagcgtggccgaggcgctgggcatgtcgctgcccggcagcgccgcgccgcccgccccggacgcgcgccgggacacctacgcgatccgcagcgggcaggccgtcgtcgccctcatcgacgccggcatcacctcgcgcgacatcctgaccaagaaggcgttcgagaacgcgatcacggtgctgatggcgctgggcgggtcgacgaacgcggtgctgcacctgatggccatcgcgcacgaggccaaggtcgacctggccctggaggacttcaaccggatcggcgagcggaccccgcacctggccgatgtcaagccgttcggccgctacgtgatgaccgacgtggaccgcatcggcggggtgccggtggtgatgaaggcgctgctggacgcgggcctgctgcacggggacacgctgaccgtcaccggcaagacgatggccgagaacctggccgagctgaacccgccggagctggacggcgacgtgctgcgcaagctgtccaatccgatccacaccaccggcgggatcaccatcctgcacggctcgctggccccggagggcgcggtgatcaagagcgccgggatcgagtacgccgagttcaccggcccggcccgggtgttcgacggcgaggccggggtgctcgaggcggtcaccaacggcacgctgggcaagggcgacgtcatcgtcatccgctgggagggccccaagggcggcccggggatgcgcgagatgctcgccgtcaccggcgcgatcaagggtgccggcctgggcaaggacgtcctgctgctcaccgacggccggttctccggcggcaccaccggcccctgcatcgggcacatcgccccggaggcagcgcacggcgggccgatcgcgctggtgcaggagggtgatcagatccggctcgacctggccgccaagaccctggacctgctggtcgacgaggccgagctggagcgacgccgggccgattgggagccccgcgagcagaacctgaacttcggggtcgccggcaagtacgccaagctggtcggctcggccgccaagggcgccgtctgcttctga

SEQ ID NO: 497 - protein, 570 aa, Cellulomonas flavigena
MTSAGGDDGVDIKPRSRQVTDGLEATAARGMLRAVGLGDEDFAKPQVGVASSWNEITPCNLSLDRLAKAVKGGVHAAGGYPLEFGTISVSDGISMGHEGMHFSLVSRDIIADSVETVMMAERLDGSVLLAGCDKSLPGMLMAAARLDLASVFLYAGSIMPGWVKLSDGTEKDVTIIDAFEAVGACARGLMSREDVDRIERAICPGEGACGGMYTANTMASVAEAMGMSLPGSAAPPSADRRRDQFAHRSGEAVVELLRRGITARRIMTKEAFENAIAVVMAFGGSTNAVLHLLAIAHEAEVDLTLEDFSRVAAKVPHLGDLKPFGRYVMNDVDRVGGVPVVMKALLDAGLLHGDCLTVTGRTVAENLAEIAPPDPDGKILRALDDPIHRTGGITILSGSLAPEGAVVKSAGFDSDVFEGTARVFERERAALDALEDGTIRAGDVVVIRYEGPKGGPGMREMLAITGAIKGAGLGKDVLLVTDGRFSGGTTGLCVGHIAPEAVDAGPIAFVRDGDRVRLDVAHATLDLLVDDAELVARREGWAPLAPRYTRGVLGKYQKLVQSASRGAVLG

SEQ ID NO: 498 - DNA, 1713 bp, Cellulomonas flavigena
atgacgagcgcaggcggggacgacggcgtggacatcaagccgcggtcgcggcaggtgaccgacgggctggaggcgacggcggcgcgcggcatgctgcgcgcggtcgggctgggggacgaggacttcgcgaagccgcaggtgggcgtcgcgtcgtcgtggaacgagatcacgccgtgcaacctgtcgctcgaccggctcgccaaggccgtgaagggcggggtgcacgcggccggggggtacccgctggagttcggcacgatctcggtgtccgacggcatctcgatgggccacgagggcatgcacttctcgctcgtgagccgggacatcatcgcggactccgtggagacggtgatgatggccgagcgcctcgacggctcggtcctcctggccgggtgcgacaagtccttgccgggcatgctcatggctgcggcgcgcctcgacctcgcgagcgtgttcctctacgcgggctcgatcatgccgggctgggtcaagctgtccgacggcaccgagaaggacgtgacgatcatcgacgcgttcgaggccgtcggggcgtgcgcccgcgggctgatgagccgcgaggacgtcgaccgcatcgagcgcgccatctgccccggcgagggtgcgtgcggcggcatgtacacggccaacaccatggcgtcggtggccgaggcgatgggcatgtcgctgcccggctcggccgcgccgccgtcggccgaccggcggcgcgaccagttcgcgcaccgctcgggcgaggcggtggtcgagctgctgcgccgtggcatcacggcccgccggatcatgaccaaggaagcgttcgagaacgcgatcgccgtcgtcatggccttcggcggatcgaccaacgccgtgctgcacctgctggccatcgcgcacgaggccgaggtggacctcacgctcgaggacttcagccgcgtcgccgcgaaggttccgcacctgggcgacctcaagccgttcggccggtacgtgatgaacgacgtcgaccgggtcggcggcgtgcccgtcgtcatgaaggccctgctcgacgcggggctgctgcacggggactgcctcacggtcacggggcgcacggtcgccgagaacctcgccgagatcgcgccgcccgacccggacggcaagatcctgcgggcgctcgacgacccgatccaccgcacgggcggcatcacgatcctgtcggggtcgctcgcgcccgagggtgcggtggtcaagtccgcgggcttcgactccgacgtgttcgagggcaccgcgcgcgtcttcgagcgtgagcgagccgcgctcgacgcgctcgaggacggcacgatccgggcgggcgacgtcgtcgtcatccggtacgagggccccaagggtggaccgggcatgcgcgagatgctcgccatcaccggggccatcaagggtgcggggctcggcaaggacgtgctcctcgtgaccgacgggcggttctcgggcggcacgacggggctctgcgtcggccacatcgcgcccgaggccgtcgacgccgggccgatcgcgttcgtccgggacggcgaccgggtgcggctcgacgtcgcgcacgccacgctcgacctgctcgtcgacgacgcggagctcgtggcccgccgggagggctgggcgccgctcgcgccgcggtacacccgtggggtgctgggcaagtaccagaagctcgtgcagtccgcgtcacgcggcgcggtgctcgggtaa

SEQ ID NO: 499 - protein, 571 aa, Rhodothermus marinus
MPPLNRYSRRITQPKSQGASQAMLLATGLKEEDLDKPQIGIASVWYEGNPCNMHLLDLAAEVKAGVQEAGMVGFRFNTIGVSDGISMGTEGMSYSLPSRDLIADSIETVMAAQWYDGLIALPGCDKNMPGCVIAMGRLNRPALMIYGGTIRPGCLNGQKLDVVSAFQSYGEYLAGKITDEQRRAIIRHACPGPGACGGMYTANTMAAAIEAMGLSLPFSSSLPAEDPRKREECRRAGHVMRRLLEQDLKPRDIVTRASLENAIAVVMALGGSTNAVLHLLAIAHAFDLPLSLDDFQRIARRVPLLADMKPSGRYVMEDLCRIGGVPAVMKLLLKHGVLHGDALTVTGKTLAENLADVPDLPENQDIIRPWDNPIKSSAHIYILYGNLAPGGCVAKITGKEGLRFSGPARVFDSEEDMLAGLEAGRIQRGDVIVIRYEGPKGGPGMPEMLTPTSALMGAGLGKDVALITDGRFSGGSHGFIIGHVVPEAQEGGPIALVRDGDRITIDAEAGLIHVDVSDEELARRRAAWTPPPLKVTRGALFRYVQTVQDASRGCITDAPIGEPQPVGSPTS

SEQ ID NO: 500 - DNA, 1716 bp, Rhodothermus marinus
atgccgccgctcaaccgctacagccgtcgcatcacccagccgaaatctcagggggcgtcgcaggccatgctgctggccaccggcctgaaggaagaagacctggacaagccccagatcggtatcgcctcggtctggtacgaaggcaacccctgcaacatgcacctgctggacctggccgccgaggtgaaggccggcgtgcaggaagccggcatggtgggcttccggttcaacacgatcggcgtctccgacggtatctcgatgggcaccgagggcatgtcctacagcctgccctcgcgcgatctgatcgcggactccatcgagacggtcatggccgcccagtggtacgacggcctcatcgcgctgcccggttgcgacaagaacatgccgggctgcgtgatcgccatgggccggctgaaccgccccgcgctgatgatctacggcggcacgatccgccccggctgcctcaacggccagaagctggacgtggtcagcgccttccagagctacggcgagtacctggcgggcaaaatcaccgacgaacagcggcgggcgatcatccgccacgcctgtccgggaccgggcgcctgcggcggcatgtacacggccaacacgatggcggcggccatcgaggccatgggcctctcgctgcccttcagctcgagcctcccggccgaagacccgcgcaaacgcgaagagtgccgccgggctggacacgtcatgcgccggcttctggagcaggacctcaaaccccgcgacatcgtcacgcgcgcctcgctcgaaaacgccatcgccgtcgtcatggcgctgggcggctcgacgaacgccgtgctgcacctgctggccatcgcgcacgccttcgacctgccgctgtcgctcgacgactttcagcgcatcgcccggcgcgtgccgctcctggccgacatgaagcccagcggccgctacgtcatggaagacctgtgtcgcatcggcggcgtgccggccgtcatgaagctgctgctcaagcacggcgtgctgcacggcgacgcgctcaccgtgacgggcaaaacgctcgccgaaaaccttgccgatgtgcccgacctgcccgagaatcaggacatcatccgcccctgggacaacccgatcaaatcaagcgcccacatctacatcctctacggcaacctggcacccggcggctgcgtggccaagatcacgggcaaagaaggactgcgtttcagcggacccgcccgcgttttcgactccgaagaagacatgctggccggactcgaagcgggccgcattcagcgcggcgacgtgatcgtcatccgctatgaaggaccgaaaggcggtccgggcatgcccgaaatgctcacgcccacctcggcgctgatgggggccggattgggcaaagacgtggcgctgatcaccgacggccgcttcagcggcggaagccacggcttcatcatcggccacgtcgtacccgaagcccaggagggcggccccatcgcgctcgtgcgcgacggcgacaggattacgatcgacgccgaagccggcctcattcacgtggacgtgtccgacgaagagctggcccgtcggcgtgccgcctggaccccgcccccgctcaaggtcacccgcggcgccctcttccgctacgtgcagaccgtgcaggacgcctcgcgcggctgcatcaccgacgccccgatcggcgaaccccaacccgtgggatctcccacttcctga

SEQ ID NO: 501 - protein, 557 aa, Planctomyces limnophilus
MLNKYSSRITQPRSQGASQAMLYATGMSREDMDKAQVGISSVWYDGNPCNMHLNKLADKVKEGVVAAGLVGMRFNTIGVSDGISMGTNGMSFSLQSRDLIADSIETVMSAQWYDANISLPGCDKNMPGCIMAMARLNRPSLMVYGGTIRAGCTPRHPKLDIVSAFQVYGEYLAGKLSDEERQEVIEHACPGAGACGGMYTANTMASAIEALGMSLPYSSSIPAEDPLKMGECLAAGKAIRTLLEKDIKPSDIMTRAAFENAMVTIMATGGSTNAVLHLIAMARAIGVSLTIDDFQKVSDRVPFIADLKPSGKYVMEDLHNVGGTPAVLKYLLEKGLLDGSCLTVTGKTLAENLEPLPGLAEGQRVIVPIETPIKETGHIRIMRGNFCPDGAVAKITGKEGLVFKGPARCYDQEEAMLKGLENNEIQKGDVIIIRYEGPKGGPGLPEMLTPTSAIMGAGLGSDVALLTDGRFSGGSHGFIVGHVTPEAQEGGPIALVKNGDIITIDAEKNSIDVDWTEADYQARKAAFVAPPYLATRGTLYKYIKNVKNASEGCVTDE

SEQ ID NO: 502 - DNA, 1674 bp, Planctomyces limnophilus
atgctcaacaagtactcgtcacgaatcacccagccacgctcgcaaggtgcctctcaagccatgctctacgccacaggcatgagccgcgaagatatggataaagcccaggttggcatttcgagtgtgtggtacgatggcaacccgtgcaacatgcacctcaataagctggccgacaaggtgaaagagggcgtcgtagccgccggcctcgtgggcatgagattcaacaccattggcgtttccgatggcatctcgatgggcaccaatgggatgtcgttctcgctgcagtcgcgcgatctgattgccgacagcatcgaaacggtcatgtcggcccagtggtacgacgccaacatttcgcttcccggttgcgataaaaacatgcctggctgcatcatggccatggctcgactcaaccgcccatcactcatggtttacggcggcaccatccgggcaggttgtactccgcgacatcccaagctcgatattgtctcggccttccaggtttatggcgaatacctcgctggtaagctgagcgacgaagagcggcaggaagtcatcgaacatgcctgtcccggtgccggtgcctgcggcggcatgtacaccgcgaatacgatggccagtgcgatcgaagctttgggaatgtcattaccctacagttcatcgatcccggcggaagatcctctcaaaatgggagaatgcctcgccgcaggcaaggctattcgcactttgctcgaaaaggatatcaagccctcagatatcatgacgcgagccgccttcgagaatgccatggtgaccatcatggccaccgggggttcaacgaacgccgtcctccacttgattgccatggctcgcgcgattggcgtctcgctcaccatcgacgacttccagaaggtttcagatcgcgtgcccttcatcgctgatctcaaaccgagtggtaaatacgtcatggaagacctgcacaacgtgggcggaactcccgcggtcctcaaatatctgctcgaaaaaggcttgctggatggcagttgcctgacggtgactggcaagaccttggccgaaaacctggagccactccccggtctggcggaaggccagcgcgtgattgtgccaattgagacacccatcaaagagactggccacatccgcattatgcgcggcaacttctgcccggacggggctgtcgccaagatcactggtaaagaagggctcgtcttcaaaggccccgctcgctgctacgatcaggaagaagcgatgctcaaggggctggaaaacaacgagattcagaagggtgatgtgatcatcatccgctacgaagggccgaagggcgggccaggtcttcccgaaatgctcaccccgacctccgccattatgggagccggtttagggagtgatgtcgcactgctgaccgacggccgcttcagtggtggatcacacggattcatcgtcggccacgtgacacccgaagcccaggaagggggcccgatcgccctcgtgaaaaacggcgacatcattaccatcgacgccgagaaaaacagcatcgacgtcgattggacagaagccgactaccaggcccgcaaagccgccttcgtcgccccaccctacctcgccacccgcggcacattatataagtatattaagaacgtgaaaaacgcgagcgaaggctgcgtgacagatgagtag

SEQ ID NO: 503 - protein, 569 aa, Beutenbergia cavernae
MTATPDTAPDIKPRSRQVTDGLEATAARGMLRAVGLGDEDFAKPQIGVASSWNEITPCNLSLDRLADAVKSGVHAAGGYPLEFGTISVSDGISMGHEGMHFSLVSREVIADSVETVMQAERLDGSVLLAGCDKSLPGMLMAAARLDLASVFLYAGSIMPGWVKLSDGTEKDVTIIDAFEAVGACARGLMSREDVDRIERAICPGEGACGGMYTANTMASVAEAMGMSIPGSAAPPSADRRRDAFAHRSGEAVVEMLRQGITARQVMTKEAFENAIAVVMAFGGSTNAVLHLLAIAYEAEVDLTLGDFQRVAARVPHLGDLKPFGRYVMNDVDRIGGVPVVMKALLDAGLLHGDCLTVTGRTVAENLEAIAPPDPDGKILRALDNPIHRTGGISILHGTLAPEGAVVKSAGFDSDVFEGTARVFDRERAAMDALEDGTITDGDVVVIRYEGPKGGPGMREMLAITGAIKGAGLGKTVLLLTDGRFSGGTTGLCVGHVAPEAVDAGPIAFVRDGDPIRLDVANATLDLLVAPAELEARRAGWEPLPPRYTRGVLAKYAKLVGSASTGAVLE

SEQ ID NO: 504 - DNA, 1710 bp, Beutenbergia cavernae
atgactgcgacccccgacaccgctccggacatcaagccccgctcgcgccaggtcaccgacggcctggaggcgaccgcagcacgggggatgctccgcgccgtcggcctcggcgacgaggacttcgcgaagccgcagatcggcgtcgcgagctcgtggaacgagatcacgccgtgcaacctgtcgctcgaccggctcgccgacgccgtcaagagcggtgtgcacgcggccggcggctacccgctcgagttcggcacgatctccgtgtcggacggcatctcgatgggccacgaggggatgcacttctcgctggtgtcgcgcgaggtgatcgccgactccgtggagaccgtcatgcaggcggagcgactggacggctccgtgctgctcgccgggtgcgacaagtccctccccgggatgctcatggcggccgcgcggctcgacctcgcgagcgtgttcctgtacgccggctcgatcatgcccggctgggtgaagctctcggacggcaccgagaaggacgtgacgatcatcgacgcgttcgaggccgtcggggcgtgcgcgcgcgggctcatgagccgcgaggacgtcgaccgcatcgagcgggccatctgccccggcgagggcgcgtgcggcgggatgtacacggcgaacaccatggcgtcggtggccgaggcgatgggcatgtcgatcccgggatcggcggcgccgccgtcggccgaccgtcgccgcgacgcgttcgcgcaccgcagcggtgaggcggtcgtcgagatgctccggcaggggatcaccgcacggcaggtcatgacgaaggaggcgttcgagaacgcgatcgccgtcgtcatggcgttcgggggctccacgaacgccgtcctccacctgctcgcgatcgcctacgaggccgaggtggacctgacgctcggcgacttccagcgcgtcgcggcgcgggtcccgcacctcggcgatctcaagccgttcggccggtacgtgatgaacgacgtcgaccgtatcgggggcgtcccggtcgtcatgaaggcgctgctcgacgccgggctcctgcacggggactgcctgaccgtcacggggcggaccgtcgcggagaacctcgaggccatcgcgccccctgacccggacggaaagatcctgcgtgcgctggacaaccccatccatcgcaccggcggcatcagcatcctgcacggcaccctcgcgcccgaaggcgccgtcgtgaagtccgcggggttcgactcggacgtgttcgagggcacggcgcgcgtgttcgaccgggagcgggccgccatggacgcgctcgaggacggcacgatcaccgacggcgacgtcgtcgtcatccggtacgaggggccgaagggcggccctgggatgcgcgagatgctcgcgatcacgggcgccatcaagggcgccggcctgggcaagacggtgctgctgctcaccgacggccggttctcgggcggcacgacggggttgtgtgtcgggcacgtcgcaccggaggccgtcgacgccgggccgatcgcgttcgtgcgtgacggcgacccgatccggctcgacgtcgcgaacgccacgctggacctcctcgtcgccccggcggagctcgaggcccgccgcgccggctgggagccgctcccgcccaggtacacccggggggtgctggcgaaatacgccaagctcgtcgggtcggcgtcgacgggtgcggtgctggagtga

SEQ ID NO: 505 - protein, 566 aa, Spirosoma linguale
MITDQSTTELNRFSRTLTQEISNPAAKAMLYGVGLSEADMQKPQIGIASTGYEGNTCNMHLNGLSVYVKQGIQASGLVGLIFNTIGVSDGMTNGNDGMRYSLPSRDLIADSIESVVAAQWYDGVVTVVGCDKNMPGAVMAMARLDRPGIMVYGGTIRSGHYKGQKLDIVSAFEALGKKYAGNISDEDYEGVIKNSIPGAGACGGMYTANTMASSIEAMGLSLPFSSSYPATHEGKQEECKKIGAAMRVLLERNITPADIITRKSLENALTIVMALGGSTNAVLHYLAIARAAGIELTLDEIQAISDRVPFLADLKPSGKYYMEDMLAIGGVPAVMKYLYQNGMLHGDCITVTGKTVAENLADAPDLNFETQQIVRPLSNPIKPTGHIQIMRGNLSPTGSVAKITGKEGLRFDGTAKVCEHEGEVIDALQKGEILPGQVIVIRNAGPKGGPGMSEMLKPTSAIMGAGLGDKVALITDGRFSGGTHGFVVGHVTPEAFDGGPIALVHDGDRITIDATTRQLILHISDEEMAQRKSEWKQPAPRFTKGTLGKYIRNVKSASEGCVTDEA

SEQ ID NO: 506 - DNA, 1701 bp, Spirosoma linguale
atgattaccgatcagtcaactaccgaattaaatcgctttagtcgcacgctcacacaggaaatatcgaatcccgcagccaaagctatgctgtatggagtcggcttgagtgaggccgatatgcaaaaaccccaaattggtattgccagcacgggttatgaaggcaatacctgtaacatgcacctaaacggtctatctgtttatgtgaagcaaggcattcaggcaagcggattggtcggattgatctttaacaccataggcgtatcagatggcatgaccaatggcaacgatggtatgcgctactcgcttcccagccgggatttgattgctgattccattgaatcggtagtagcagctcaatggtacgatggtgttgtaaccgtggttggctgtgacaaaaacatgccgggtgccgttatggccatggcgcgtctcgaccggcccggtattatggtatatggcggcaccatccggtcgggtcattataaaggacagaaattagacatcgtttcggcgtttgaagcgctgggtaaaaaatacgcgggcaacatttcggacgaagattacgagggcgtaatcaaaaactcgattccgggtgccggtgcctgtggcggtatgtatacggccaataccatggccagcagcattgaagcgatggggttaagcttgcccttcagcagcagctacccggccacccacgaaggtaaacaggaagagtgcaaaaaaattggtgcagccatgcgcgtgttgctcgaacgcaacatcacccctgccgacatcattacccgtaaatcgctcgaaaacgcactcacgattgttatggcattgggcggctctaccaatgcggtactgcattacctggccattgcccgggcagccggtattgagctaaccctcgacgaaattcaggcgatcagcgaccgggttccgttcctggccgatctgaagccaagtggtaaatactatatggaagatatgctcgccattgggggtgtaccagccgtaatgaagtacctctaccaaaacggcatgctgcacggcgactgtataaccgtaaccggtaaaaccgtagctgaaaacctcgccgacgcgcctgatctgaatttcgagacacagcagattgtacggccgctgagcaatccgatcaaaccaaccggccacattcaaatcatgcgcggcaacttgtcgccaaccggctcagttgccaagattacgggtaaagaaggtctacgtttcgacggtactgcaaaagtatgtgagcacgaaggcgaagtaatcgacgccctgcagaaaggtgaaatcttacccggtcaggttatcgttattcggaacgccgggccaaaaggtggtcccggtatgagcgagatgctgaaaccaacctcggccatcatgggcgcgggtctaggcgacaaagtagcgctgatcaccgatggacgcttttcgggtggtacccacggctttgtcgtgggacacgttacgcccgaggctttcgacggtggaccaatcgcgctggtacatgacggcgaccgcattaccatcgacgccactacccgccagctgattctgcacatttcggacgaagagatggcgcagcgtaaaagcgaatggaagcaaccggctccccgcttcacaaaagggacgctgggtaagtacatccgcaatgtaaaatcggcgagcgaaggctgcgtaacggacgaagcctaa

SEQ ID NO: 507 - protein, 565 aa, Sphaerobacter thermophilus
MVETPTAVDLRHKSRTIVEGRDRAGARAMLRATGLTDEDFRKPVIGVAHSWIETMPCNLGLRRLAQHVKRGIRDAGGVPMEVNTVAISDGVTMGTQGMKASLISREVIADSIELVGRGHMFDAIVILAACDKTLPGSAMALIRLDIPGFILYGGTIAPGHFQGRDVTIQDVYEAIGANAAGKMSDADLLELERVACPGEGACGGQYTANTMAMAIEALGLSPVGFGSWPQADPGKNEIAYQAGRLVVEQLERGLKPSDILTREAFLNGIALAAGTGGSTNIVLHFLAMAREAGIPLSIDDFNPVSERTPVIADLKPSGKYTAVDVHRAGGTQLIIKRLIEGGYMDGSQLTPSGRTLAEEVADATETPGQQVILTPETAKQPTGGLVILKGNLAPEGAVIKVAGTERTRHEGPARVFDCEEDAMAAVTSQQIRPGDVVVIRYEGPRGGPGMREMLGVTAALVGEGLGESVALLTDGRFSGATRGFMVGHVAPEAAVGGPIAALRDGDIITIDIAARTLDVTLTDEEIAARMAEWTPPPPPSGTGVFAKYAALVSSASEGAIMQPRW

SEQ ID NO: 508 - DNA, 1698 bp, Sphaerobacter thermophilus
atggtcgagacgccgactgccgtcgacctgcggcacaagagccgcacgatcgttgaagggcgcgaccgtgccggagcgcgcgccatgctgcgggccaccggtctgaccgacgaggacttccgcaagccggtcatcggcgtggcgcactcctggatcgagacgatgccctgcaacctcgggttgcggcgcctggcgcagcacgtcaagcgcggtatccgcgacgcgggcggggtgccgatggaggtcaacaccgtcgcgatcagcgacggcgtgacgatgggtacccaggggatgaaggcctcgctgatcagccgcgaggtgatcgccgactcgatcgagctggtcggccgggggcacatgttcgatgccatcgtcatcctggcggcctgcgacaagaccctgcccggctcggccatggcactgatccggctcgatatcccgggcttcatcctctacggcggcacgatcgcccccggacacttccagggccgcgacgtaacgatccaggacgtctacgaggcgatcggcgccaacgcggccgggaagatgagcgacgccgacctgctcgagctggagcgggtcgcctgcccgggcgagggcgcctgcggcgggcagtacaccgccaacacgatggccatggcgatcgaggcgctggggctctccccggtcggattcggctcctggccgcaggccgacccgggcaagaacgagatcgcctaccaggcggggcgcctggtggtcgagcaactcgagcgaggtctgaagcccagcgatatcctgacccgcgaggccttcctcaacggcatcgccctggcggccggcaccggcgggtcgaccaacatcgtgctccacttcctggccatggcgcgcgaggccggcatcccgctcagcatcgacgacttcaacccggtgagcgagcggacgccggtcatcgccgacctcaagccctccggcaagtacacggcggtcgatgtgcaccgggcgggcggcacgcagctcatcatcaagcgcctaatcgagggcggctacatggacggcagccagctcacgccgagcgggcgcacactggccgaggaagtggcggacgcgaccgagacgcccggccagcaggtgatcctgacgccggaaaccgccaagcagcccaccggcgggctggtgatcctgaaggggaaccttgcgcccgagggtgcggtgatcaaggtagccggaaccgagcgcacccggcacgagggaccggcgcgcgtcttcgactgcgaagaggacgcgatggcggccgtcaccagccagcagatccgaccgggcgacgtggtggtcattcgctacgaggggccgcgcggcgggccgggcatgcgcgagatgctcggcgtgaccgcggcgctcgtaggtgaggggctgggcgagtcggtcgcgctgctgaccgacggacgcttcagcggtgccacgcgcggcttcatggtcggccacgtcgccccagaagcggcggtcggcgggcccatcgccgcgcttcgagacggagatatcatcaccatcgacatcgcggcgcgcacgctcgacgtcacgctgaccgacgaggagatcgctgctcgcatggccgagtggacgccacccccgccgccgtcggggaccggcgttttcgccaaatacgccgcgctcgtctcctcagcctccgagggcgcgatcatgcagccgcgctggtga

SEQ ID NO: 509 - protein, 570 aa, Lactococcus lactis
MEFKYNGKVESVELNKYSKTLTPRSTQPATQAMYYGIGFKDEDFKKAQVGIVSMDWDGNPCNMHLGTLGSKIKSSVNQTDGLIGLQFHTIGVSDGIANGKLGMRYSLVSREVIADSIETNAGAEYYDAIVAIPGCDKNMPGSIIGMARLNRPSIMVYGGTIEHGEYKGEKLNIVSAFEALGQKITGNISDEDYHGVICNAIPGQGACGGMYTANTLAAAIETLGMSLPYSSSNPAVSQEKQEECDDIGLAIKNLLEKDIKPSDIMTKEAFENAITIVMVLGGSTNAVLHIIAMANAIGVEITQDDFQRISDIIPVLGDFKPSGKYMMEDLHKIGGLPAVLKYLLKEGKLHGDCLTVTGKTLAENVETALDLDFDSQDIMRPLKNPIKATGHLQILYGNLAQGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVSNEEIAKRRANYQKPTPKATRGVLAKFAKLTRPASEGCVTDL

SEQ ID NO: 510 - DNA, 1713 bp, Lactococcus lactis
atggaattcaaatataacggaaaagttgaatcagtggaactcaataaatattctaagacattgactccaagatcaacacaaccagcgactcaagcgatgtactacggcattggttttaaagatgaggatttcaaaaaagctcaggtcggaatcgtcagcatggattgggacggaaatccatgtaatatgcacttgggaacacttgggagtaaaatcaaaagttctgtcaaccaaactgacggattgattggacttcaatttcatactattggagtttctgatggaattgctaacggaaagcttggcatgagatattctttggtcagtcgtgaagttattgctgacagcatcgaaaccaacgctggcgcagaatattatgatgccatcgttgccattcccggttgtgataaaaatatgcccgggtcaattatcggaatggctcgcttaaatcgtccgtcaattatggtctatggtggaacgattgaacatggcgaatataaaggtgaaaaattaaatattgtttcggcctttgaagctctggggcaaaaaatcactggaaatatttctgatgaagattatcatggcgttatttgcaatgccattccaggacaaggtgcttgcggaggaatgtacactgccaataccctggctgctgctattgaaactttgggaatgagtttaccttattcctcttccaatccagcagtcagtcaagaaaaacaagaagagtgtgatgacattggtttagccatcaaaaatttattagaaaaagatattaaaccaagtgatatcatgaccaaagaagcttttgaaaatgccataacaattgtcatggtccttggaggctcaaccaatgctgtgcttcatatcattgcaatggcaaatgccattggtgtagaaattacgcaagatgatttccaacgtatttcagatattatccctgttcttggcgatttcaaaccgagcggaaaatatatgatggaagatctgcacaaaattggtggccttcctgctgttttgaaatacctacttaaagaaggaaaacttcacggtgattgtttgaccgtcacaggtaaaactttggctgaaaatgttgaaacagcattagatttggactttgacagtcaagatattatgcgaccactaaaaaatccaattaaagctactggacatttacaaattttgtacggtaatcttgcccaagggggttctgttgcaaaaatttctggtaaagaaggcgaatttttcaaaggaacagctcgtgtttttgacggagaacaacactttatcgatggcattgagtctggccgattgcatgccggtgatgttgcggtcattagaaatattggcccagtcggaggtccgggaatgccagagatgttaaaaccaacctcagcattaattggagcaggacttggaaaatcttgtgccctaattactgacggaagattttctggtggcacacacggctttgttgtgggtcatatcgtccctgaagcagttgaaggtgggttgattggtttagttgaagatgatgatattatcgaaattgatgcggtgaataatagtattagtttaaaagtttctaatgaagaaattgctaaacgacgtgccaattatcaaaaaccaacccctaaagcaacgcgtggtgttcttgcaaaatttgccaaacttacgcgccccgctagtgaaggttgcgttacagatttatag

SEQ ID NO: 511 - protein, 555 aa, Thermus thermophilus
MRSDQIKKGLKQAPARAMLRAVGVGDEDFGRPFVGVVNTFTDGMPCNFHLRELAQHLKAGLKEAGLFPFEFGAPAISDGISMGTPGMRASLVSREVIADSVELIAQGYLYDGMVGLSACDKTIPGTAMGVIRSGVPGMILYGGTIAPGEWQGRKLTIVEVFEAVGQRAAGKISEEELLEIERRAIPGPGACGGQYTANTMAMALEALGLSPVGYNAIPAVHPEKERATKEAGKILAWAIAHDWKPKDFLTRKSFLNAIAAVAATGGSTNAVLHLLALAKEAGVELSLDDFDQISRKTPVIADLRPWGTYTAWELYEAGGTALVFKRLLEAGLLFGEEKTLTGRTLAEEVERAYREQEGQKVVFPVEKALKPHGGLVVLKGNLAPKGAVLKLAGTERTYFEGPARVFDSEEAAMEKVLKGEIRPGDVVVIRYVGPKGAPGMPEMLSVTSAIVGEGLGPEVALLTDGRFSGGTRGLMIGHIAPEAFVGGPIALLEEGDRIRIDVEGRRLEVLLPEEELERRRARWRPRPPAFTHGLFARYAALVRQADEGAVLEDPL

SEQ ID NO: 512 - DNA, 1668 bp, Thermus thermophilus
atgaggtcggaccagatcaagaagggactcaagcaggcccccgcccgcgccatgctccgggcggtgggggtaggggacgaggacttcggaaggcccttcgtgggggtggtgaacaccttcaccgacgggatgccctgcaacttccacctgcgggagctggcccagcacctcaaggccgggctcaaggaggcggggcttttcccctttgagttcggggctcccgccatctccgacgggatcagcatgggcaccccgggcatgcgggcgagcctcgtaagccgcgaggtcatcgccgacagcgtggagctcatcgcccagggctacctctacgacggcatggtggggctttccgcctgcgacaagaccatcccgggaacggccatgggggtgatccgcagcggcgtccccggcatgatcctctacggggggacgatcgcccccggggagtggcaaggccggaagctcaccatcgtggaggtctttgaggcggtggggcaaagggccgcggggaagatcagcgaggaggagcttttggagattgaacgccgggccatccccggccccggggcctgcggcggccagtacaccgccaacaccatggccatggccctcgaggccctgggcctctcccccgtgggctacaacgccatccccgccgtccaccccgaaaaggagcgggccaccaaggaggcggggaaaatcctcgcctgggccatcgcccacgactggaagcccaaggacttcctcacccggaaaagcttcctcaacgccatcgccgccgtggccgccacgggggggagcaccaacgccgtcctccacctcctcgccctggccaaggaagcgggggtggagctcagcctggacgactttgaccagatttcccgcaagaccccggtgatcgcggacctccgcccttggggcacctacaccgcctgggagctctacgaagccggggggacagccctcgtcttcaagcggcttctggaggcggggctcctctttggggaggagaagaccctcacgggccgcaccctggcggaggaggtggagcgggcctaccgggaacaagaggggcagaaggtggtcttccccgtggagaaggccctcaagccccacggggggctcgtggtgctcaagggaaacctcgcccctaaaggcgccgtcctcaagctcgcggggacggagcgcacctactttgagggcccggcccgggtctttgactcggaggaggcggccatggagaaggtcctgaagggggagatccggcctggggacgtggtggtcatccgctacgtgggccccaagggggcaccggggatgcccgagatgctctcggtgacgagcgccatcgtgggggaaggcctggggccggaggtggccctcctcaccgacggccgcttctccgggggcacccgcggcctcatgatcggccacatcgcccccgaggccttcgtgggcgggcccatcgccctcctggaggagggggaccgcatccggattgacgtggaaggccgccgcctcgaggtcctcctccccgaggaggagctggaaaggcggagggcccgctggcggccccgaccccccgccttcacccacggcctcttcgcccgctacgccgccctggtgcgccaggcggacgagggggcggtgctggaagacccgctctag

SEQ ID NO: 513 - protein, 562 aa, Anabaena variabilis
MSENLRSQIVTQGVQRSPNRAMLRAVGFKDEDFNKAIVGIANGYSTITPCNMGINQLALRAEVGIKSAGAMPQMFGTITISDGISMGTEGMKYSLVSREVIADSIETACTGQSMDGVLAIGGCDKNMPGAMLAIARMNIPAIFVYGGTIKPGHYNGRDLTVVSSFEAVGQYSAGKIDDKELLEVESHACPGAGSCGGMFTANTMSGAFEALGMSLPYSSTMAAEDAEKADSTEKSAFVLVEAIRKQILPSQIITCKSIENAISVIMAVGGSTNAVLHFLAIAHAANVELTLDDFETIRARVPVLCDLKPSGKYVATDLHEAGGIPQVMKMLLVHDLLHGDCLTITGQTIAEILADIPEEPSVNQDVIRTWNNPMYPQGHLAILRGNLATEGAVAKITGVKKPVITGTARVFESEEASLDAILAGKIQAGDILVIRYEGPKGGPGMREMLAPTSAIIGAGLGDAVGLITDGRFSGGTYGMVVGHVAPEAAVGGAIALVEEGDSITIDAPARLLQLNISDHELARRHANWQPPVPRYTKGVLAKYAKLVSSSSLGAVTDLDLFN

SEQ ID NO: 514 - DNA, 1689 bp, Anabaena variabilis
atgtcggagaatttaagaagccaaattgtgacccaaggggtgcagcgatcgcctaatcgagctatgctgcgtgcagttggttttaaagatgaagattttaataaagccattgtgggtatagccaatggttacagcactatcacgccctgcaatatggggataaatcaactggcgctcagagcagaagttggcataaagtctgccggagcaatgccacaaatgtttggcacaattaccatcagcgacggcatttcgatgggaactgaagggatgaaatattccctagtgtcgcgggaagtcattgctgattccattgaaaccgcctgtactggacaaagtatggatggtgtactagccattggcggttgtgataaaaatatgccaggagcaatgctagcgatcgcgcggatgaatatccctgcaatattcgtttacggtggcacaattaaacctggtcactataacggacgcgatttaactgttgtcagttcttttgaagctgttggtcaatacagtgctggaaaaattgacgacaaggaattattagaagtcgaaagtcatgcttgtcctggtgcaggttcctgcgggggaatgttcacggctaacaccatgtcgggagcatttgaagcactggggatgagtttaccttattcttcgacaatggcagccgaagatgccgaaaaagccgacagcacggaaaaatcagcatttgtattagtcgaagccattcgtaaacaaatcttacccagccaaattatcacctgcaaatctatagagaatgccatctctgtgattatggcggtgggtggttcgaccaatgcagtgttgcattttttagcgatcgcccacgctgctaatgtagagttaactctggatgactttgaaactatccgcgctcgtgttcccgttttgtgtgatttaaaacctagtggtaagtatgtcgctaccgatttgcacgaagctggtggcattccccaagtcatgaagatgctactcgtgcatgacttgttacatggtgattgcctgaccatcactggtcaaacaattgcagagatattagcagacatacccgaagaaccatctgttaatcaagatgtaattcggacttggaataacccgatgtatccccaaggacacttagccatcctcagaggtaatctggcaacagaaggtgctgtcgctaaaattactggcgtgaaaaaaccagtaattaccggaactgcaagggtgtttgagtcggaagaagcttctttagatgcaattttggcggggaaaattcaagctggtgatattttggttatccgctacgaagggcccaagggtggccctggaatgcgagaaatgttggctcccacttcggcaattattggtgctggcttgggtgatgcggtgggattaattaccgatgggcgcttttctggcggtacttacggtatggtagttggtcatgttgctccagaagcagccgtgggtggtgcaatcgctcttgtagaagaaggcgatagtattaccattgatgcacctgcacgtctcttgcagttgaacatatctgatcatgaattagctcgtcgtcatgctaattggcaacctcctgtaccacgttacactaaaggcgtgttggcgaaatatgccaaattggtatcttctagcagtcttggggctgtgacagatttggatttgtttaattga

SEQ ID NO: 515 - protein, 585 aa, Roseovarius sp.
MTKFDKAKLPSRHVTEGPERAPHRSYYYAMGMTEAEIHQPLVGVATCWNEAAPCNISLNRQAQAVKGGVKEAHGSPREFTTITVTDGIAMGHEGMRSSLASREAIADTVELTMRGHCYDALVGLAGCDKSLPGMMMAMVRLNVPSVFIYGGSILPGKAPQVEEIPADFRSRDLTVQDMFEAVGRHQNAEMSDKALDMLERVACPSAGACGGQFTANTMACVSEAIGLALMNSSGMPAPYESRDQYAEASGRAVMQLLEKNIRARDVVTLKSLQNAARVVACTGGSTNAGLHLPAIAHEAGIDFFLEDVCDIFRDTPYFVDLKPGGAYVAKDLYDAGGIPVVMKELRKAGLIHEDCMTASGRSIGEELDLIERVADGKVIYPIETPITKTGGVVGLKGNLAPTGAIVKVAGIAPEHQVFTGPARVFECEEDAFEAVKARNYKEGEVIVIRNEGPAGGPGMREMLSTTAALSGQGMGKKVALITDGRFSGATRGFCVGHVGPEAAHGGPIALIATGDMITIDAIKGELSVDLSDEDLAARKAAWAGPRETIYASGALWKYAQLVGETYKGAVTHPGAAFERHVYMDL

SEQ ID NO: 516 - DNA, 1758 bp, Roseovarius sp.
atgaccaagttcgacaaagccaaactgcccagccgccatgtgaccgaaggaccggagcgcgcgccgcatcggtcctattactatgccatgggcatgaccgaggcggagatccatcagcccttggtcggtgtggcgacctgctggaacgaggcggccccctgcaatatctcgctcaaccgtcaggcgcaggccgtcaagggcggcgtgaaagaggcgcatggcagcccgcgcgagttcaccacaatcacggtgacggacggcattgcgatggggcatgagggcatgcgcagttctctggcgagccgcgaggcgattgccgatacggtggaattgacgatgcgcggccattgctatgacgcgctggtggggctggcgggctgtgacaagagcttgccggggatgatgatggcgatggtgcggttgaatgtgccgtcggtgttcatctatggcgggtcgatccttccgggcaaggcgccgcaggtcgaggaaatcccggcggatttccgcagtcgcgatctgaccgtgcaggatatgttcgaggccgtggggcggcatcagaacgccgagatgtccgacaaggcgctcgatatgctggagcgggtggcctgcccgtcggcgggagcctgtggtgggcaatttactgccaataccatggcctgtgtgtctgaggcgatcggtctggcgctgatgaattcctcgggcatgcccgcgccctatgagagccgtgatcaatatgccgaggcctctggccgggcggtgatgcagctcctggaaaagaacatccgggcgcgcgatgtggtgacgctcaagagtttgcagaatgcggcgcgggtcgtggcctgcaccggcggcagcaccaatgctggtctgcacctgcctgcgattgcgcatgaggcggggattgatttctttcttgaggatgtctgcgacatcttccgcgacacgccctatttcgtcgatctgaagccgggcggggcctatgtggccaaagacctttatgacgcgggcggcatcccggtggtgatgaaggaactgcgcaaggcggggctgatccatgaggattgcatgaccgcgagcgggcgcagcatcggcgaagagctggacctgatcgagcgtgtggccgatggcaaggtgatctatccgattgaaacgccgatcaccaagaccggcggcgttgtcggcctcaagggcaatctggccccgacgggtgcgattgtgaaggtcgcggggattgcccctgagcatcaggtctttaccggcccggcgcgggtgtttgagtgcgaagaggatgcgttcgaggcggtcaaggcgcgcaattacaaggagggcgaggtgatcgtcatccgcaacgagggcccggcgggcggccccggcatgcgtgaaatgctgtcgaccacggcggcgctcagcggtcagggcatgggcaagaaggtggcgctgattaccgatggccggttctcgggcgcgacgcgtggcttctgcgtgggccatgtcggccccgaggcggcgcatggtgggccgattgccctgattgccaccggtgacatgatcacgattgacgcgatcaagggtgagttgtcggtggatctgagtgacgaggatctggccgcgcgcaaggccgcgtgggccggtccgcgcgagacgatctatgccagcggggcgttgtggaaatatgcgcaattggtgggcgagacctacaagggcgctgtgacccatcccggtgcggcgttcgagcggcatgtctatatggacctctga

SEQ ID NO: 517 - protein, 557 aa, Prochlorococcus marinus
MNKLRSSAITQGVQRSPNRSMLRAVGFNDEDFNKPIIGVANGYSTITPCNVGLNKLALKAEESIKRSGGMPQMFGTITVSDGISMGTEGMKYSLVSREVIADSIETACNAQSMDGVLAIGGCDKNMPGAMIAIARMNIPSIFIYGGTIKPGKLHGEDLTVVSAFEAVGQLTSGKINEERLIQVEKNCIPGAGSCGGMFTANTMSAVIEVLGLSLPHSSTMAAEDLEKELSADKSAEILVSAIEKDIKPLDLMTKKAFENAISVIMAIGGSTNAVLHILAIANTAGIDININDFERIRQKVPVICDLKPSGKYVTVDLHKAGGIPQVMKILLNAGLIHGDCKNIEGKTISEYLQNIPDKPPTNQNVIRDINDPLYKKGHLAILKGNLASEGSVAKISGVKNPVLTGPAKIFESEEDCLKSILNNDIKAGDVVVIRNEGPVGGPGMREMLAPTSAIVGQGLGEKVALITDGRFSGGTYGLVVGHIAPEAAVGGNIALIKQGDLITVDAAKQLIEVDLSDEELEKRKKDWVKPIQKYKRGILSKYSRIVSTSSLGAVTDL

SEQ ID NO: 518 - DNA, 1674 bp, Prochlorococcus marinus
atgaataaactcagatcatctgcaataacacaaggtgtgcaaagatcccctaacagatcgatgttaagagctgttggatttaatgatgaagattttaataaacctattatcggagttgcaaatggatacagtaccataacaccatgcaatgtaggtttaaataagttagctctcaaagctgaagagtcaataaaaagatcaggtgggatgcctcagatgtttggaacgataacagtaagtgatggtatttctatgggaacagagggcatgaaatattccttagtttcaagagaagttattgctgattcaattgaaacagcatgcaatgctcagagtatggatggagtgcttgctataggtggatgtgacaaaaatatgccgggtgccatgatagcgattgcaagaatgaatattccctcaattttcatttatggagggacgatcaaacctggaaagttgcatggagaagatcttactgttgttagtgcatttgaagctgttggacaattaacatcaggcaaaattaatgaagaaaggctaatccaagttgagaaaaattgtattcctggtgctggcagctgtggagggatgtttacagctaatacaatgtctgcagttattgaagttttagggttaagtcttcctcacagttccactatggctgctgaagatctcgaaaaagaactaagtgcagataaaagtgctgagatattagtctctgcaattgaaaaagatataaaacctctagacctaatgactaagaaagcatttgaaaatgcaatatcagtaattatggcaattggcggatcaacaaatgcggtgttgcacatcttagctattgcgaatactgcaggaatagatatcaacattaatgattttgaaagaatcagacaaaaagtaccagttatttgtgaccttaaaccgagtggtaaatatgtgacggtggatctgcataaggcaggtgggattccacaagtaatgaaaatactattgaatgcaggattaattcatggcgattgcaaaaacattgaaggcaaaaccatctcagaatacttacaaaatattccagataagcctccaaccaatcaaaatgtcataagagacataaatgaccctctttataaaaaaggacatctagcgatattaaaaggtaacttagcgagcgaaggttctgtagctaaaattagcggagtaaaaaaccctgtattaacaggtcccgcaaagatttttgaaagtgaagaggattgtttaaaatcgatattaaataacgatatcaaagcaggtgatgttgttgttattagaaacgaaggtcctgtaggaggtccaggcatgagagaaatgttagctccaacatctgcgattgttggtcaagggcttggagagaaggtggctttaattacagatggcagatttagcgggggtacctatggtcttgttgtaggtcacatagctccagaggctgccgtaggaggaaatattgctctaataaaacaaggtgatttaattacagtagatgctgcaaaacaactaattgaagttgatttatctgacgaagaattagaaaaaaggaaaaaagattgggtaaaacctattcaaaaatacaaaagaggaattctttcaaaatattcgagaatcgtaagcacttcaagtttaggggctgttactgatttataa

SEQ ID NO: 519 - protein, 588 aa, Burkholderia xenovorans
MTNLHKHRSRRVTDGVTRAPHRAFLRATGLDDESMQKPFVAIVDTFGENTPCSMSLNQVSDNARLGIAAGGGVPIRGSAISVSDGTSMNHSGMRMSLVSREVVADSVELFVRAHNYDALIGVAGCDKTLPGILMGMVRVNVPGVFLFGGAMLPGVAPGQLPGGAGHGLRRQATILSTIEAVGTAQRGDISRAQLDAIEKQCTPTAGSCPGQFTANTMAMVAETLGLAPLGSAMVPAVYSERIAIARRAGETVMRILKQGGPLPRDLVTLESLENACAAVAATGGSTNAALHIPAIANEAGIRFTLDDVQRVFAKIPLIGDLQPGGRYLAQDLHHAGGVPAVLNALLEGGFLHGDAPALGGGTLADALNAYDGPDGTVVRPCSEPLGENGGLVILRGNLAPDGACLKIAGLKSLTFTGAVRIFECEEDCMAVVAARDYREGDVLVIRNEGPKGGPGMREMLSVTAAIYGQGMGEKVALLTDGRFSGATRGMCIGYVGPEAAAGGPIGLLRNGDRVHIDAREGILRVDLSDDELARRRASAPARPPRRLAGVLEKYEALVRPAHLGAVTHSGNVEWPYDAPTPGDDGAAE

SEQ ID NO: 520 - DNA, 1767 bp, Burkholderia xenovorans
atgaccaatctgcacaaacatcgctcgcgcagggtgaccgacggcgtcacgcgggcgccgcatcgcgcgttcctgcgcgccaccggtctcgacgacgaatcgatgcaaaagccgttcgtcgcgatcgtcgatacgttcggcgagaacacgccgtgttcgatgtcgctcaaccaggtctccgacaacgcgcggctcggcattgccgcgggcggcggcgtgccgatccgcggttcggcgatctcggtgtcggacggcacgtcgatgaatcactccggcatgaggatgagcctcgtgtcgcgcgaagtggtggccgatagcgtcgagctgttcgtgcgcgcgcacaactacgatgcgttgatcggcgtcgccggttgcgacaagaccttgcccggcatcctgatgggcatggtgcgcgtcaacgtgcccggcgtgttcctgttcggcggcgcgatgctgcccggcgtcgcgcccggccagttgcctggcggagcgggccacggcctgcgccgccaggccacgattctcagcacgatcgaagcagtcggcaccgcgcagcgcggcgacatcagccgcgcgcaactcgacgccatcgaaaagcaatgcacgccgaccgccggctcgtgtcccggccagttcaccgcgaatacgatggcgatggtcgcggaaacgctgggcctcgcgccgctcggttccgcgatggtgccggccgtctacagcgaacggattgcgattgcgcgccgcgcgggcgaaacggtgatgcgcatcctcaaacagggtggcccgttgccgcgcgacctcgtcacgctggaaagcctcgaaaacgcctgcgcggcggtcgcggcaaccggcggctcgaccaacgcagcgctgcatattccggcaatcgccaacgaagccggcatccgcttcacgctggacgacgtgcagcgcgtgttcgcgaagattccgctgatcggcgatctgcaaccgggcggccgctatctcgcccaggatctgcatcatgccggcggcgtgccggccgtgctgaatgcgctgctggaaggcggctttctgcatggcgacgcaccggcgctcggcggcggcacgctcgccgacgcactgaatgcgtacgacggaccggacggcacggtggtgcgcccgtgcagcgaaccgctcggcgagaacggcggcctcgtgatcctgcgcggcaatctcgcaccggacggcgcatgcctgaagatcgccgggctgaagtcgctgacgttcacgggcgcggtacgaattttcgagtgcgaagaggactgcatggcggtggtcgccgcgcgcgattatcgcgaaggcgatgtattggtgatccgcaacgaaggcccgaaaggcggtcccggcatgcgcgaaatgttgagcgtcacggcggcaatctacggccagggcatgggcgaaaaagtggcgctgttgaccgatggccgtttctccggcgcgacacgcggcatgtgcatcggctacgtggggccggaagcggcggccggcggaccgatcggcctgctgcgcaacggcgaccgcgtgcatatcgacgcgcgcgaaggcattctgcgcgtcgatctgtccgacgacgaactcgcccggcgccgcgccagcgcgcccgcgcgcccgccgcgccgactcgccggcgtgctcgaaaaatacgaggcgctggtgcggcccgcgcatctcggcgcggtcacgcactcgggcaacgtcgaatggccgtacgatgcgccgacgcccggcgacgacggagccgccgaatga

SEQ ID NO: 521 - protein, 571 aa, Saccharomonospora viridis
MAEAHPVDPRPRSREVTDGLERTAARAMLRAVGMGDADFAKPQVGIASSWNEITPCNLSLRRLAEASKQGVHAGGGYPLEFGTLSVSDGISMGHQGMHFSLVSREVVADSVETVLEAERLDGAVLLAGCDKSLPGMLMAAARVDVAAVFVYAGSTLPGRVDDRELTIIDAFEAVGACSRGLMSAEDVERVERAVCPGEGACGGMYTANTMACAAEALGMALPSSASPPSVDRRRDVLARASGEAAVELLRRGITATDVLTREAFENAIAVVMAFGGSTNAVLHLLAIAHEAGVPLSLDDFSRIGDRVPHLADVKPFGRYVMATVDRVGGVPAVMRALLEAGLLHGDCLTVTGRTVAENLAEIDPPELDGTVIRRLDDPLHPAGGITILYGSLAPEGAVVKSAGFDATRFEGRARVFDGEQAAMAALNELSAGDVVVIRNEGPRGGPGMREMLAVTGAIKGAGLGRDVLLLTDGRFSGGTTGLCVGHVAPEAAHGGPIAFVRDGDPIAADLSTRTLELRVDDAELARRREGWRPPGIAHRGVLGKYARLVGSASRGAVCPASSESPRDYPTG

SEQ ID NO: 522 - DNA, 1716 bp, Saccharomonospora viridis
atggccgaagcacaccccgtcgaccccagaccccgcagccgggaggtcaccgacggtctcgaacgcacggccgcgagggcgatgttgcgggcggtggggatgggtgacgccgacttcgcgaaaccgcaggtggggatcgcgtcgtcgtggaacgagatcaccccgtgcaacctgtcgctacgcaggctcgcggaggcgagcaaacagggtgtgcacgccggcggcggatatccactggaattcggcacgctctcggtctccgacgggatcagcatgggacatcagggcatgcacttctccctggtgtcgcgcgaggtcgtcgccgattcggtcgagacggtgctggaggccgagcgactggacggcgcggtgctgctcgccggatgtgacaagagtctgcccggcatgctcatggccgccgctcgcgtcgacgtcgccgccgtgttcgtctacgcgggatcgacgctgccgggacgtgtcgacgatcgggagctcacgatcatcgacgcgttcgaggccgtgggcgcgtgttcccgtgggctgatgagcgccgaggacgtcgaacgggtcgagcgcgccgtgtgtcccggcgagggtgcgtgcggcggcatgtacacggccaacacgatggcgtgcgcggcggaggcgttggggatggcgctgccgtcctcggccagtcccccgtcggtcgatcggcgcagggacgttctggcccgtgccagcggggaggccgccgtcgagctgctgcgcagggggatcacggcaaccgacgtcctcaccagggaggcgttcgaaaacgccatcgcggtggtgatggccttcggcggctccaccaacgccgtgttgcacctactggcgatcgcgcacgaagccggggtaccgctgtcgttggacgacttctcccggatcggtgatcgcgttccgcacctggcggacgtcaagccgttcgggcggtacgtgatggcgacggtcgaccgggtcggcggggtgccggcggtgatgcgggcgttgctcgaggcggggctgttgcacggcgactgcctcaccgtcaccgggcggacggtggcggagaacctcgcggagatcgacccacccgaactggacgggaccgtcatccgccgactcgacgaccccctccaccccgccggggggatcaccatcctgtacggcagtctcgcgccggagggcgccgtggtgaaaagcgccggtttcgacgccactcgcttcgagggccgggcccgcgtcttcgacggcgaacaggcggcgatggcggcgctgaacgagttgtccgcgggcgatgtcgtggtgatccggaacgaagggccgcgtggtgggccggggatgcgggagatgctggccgtcaccggtgcgatcaaaggggcggggctcggtcgtgacgtgttgctgctgaccgacggccgcttctcgggcggcaccaccgggctgtgcgtcgggcacgtcgcacccgaagcggcacacggtggaccgatcgcgttcgtccgtgacggcgatccgatcgcggccgacctgtcgacgaggacactggagttgcgggtggacgacgcggaactcgctcggcgtcgagagggctggcggccaccggggatcgcccaccggggtgtgctgggcaagtacgcgcggctggtggggtcggcctcgcggggtgccgtgtgcccggcgtcgtcggaaagcccgcgcgactacccgaccggatga

SEQ ID NO: 523 - protein, 565 aa, Pedobacter heparinus
MSQTPEINRYSKTFTQDPTQPAAQAMLYGIGLTAADMDKAQVGIASMGYDGNTCNMHLNDLAKIVKEGVWKNDMVGLTFSTIGVSDGMSNGTDGMRYSLVSRDVIADSIETICGGQYYDGLITIPGCDKNMPGSVMAMGRLNRPSIMVYGGSIHSGKWKGQSLNIVSAFEALGQKLAGNLEEEDFQGVIKNACPGAGACGGMYTANTMASAIEALGMSLPYSSSHPATSDEKKNECLEAGKYIRILLERNILPSDIMTEKAFRNAIVIVMVLGGSTNAVLHLIAIARSVGIDLKLDDFQHISDSTPVLGDLKPSGTYLMEDLHEIGGVPAVMKYLLKVGLIDGDCITVTGKTIAENVADAADLDFETQKIIFPIENPIKETGHLQMLYGNLATKGAVAKISGKEGERFTGPARVFDGEKSLMAGIQSGRLKSGDVVVIRQVGPKGAPGMPEMLKPTSLIIGAGLGKSVALITDGRFSGGTHGFVVGHITPEAWDGGNIALVHDDDIITIDAVNNSIDVHLTDEQLATRRAVWKQLPPPVTKGVLYKYLKQVSNASEGCVTDAYTD

SEQ ID NO: 524 - DNA, 1698 bp, Pedobacter heparinus
atgtcacaaacacctgaaattaaccgatacagcaaaacatttactcaagatcctacacagccggctgcacaggccatgttgtatggaattggactgaccgcagcagatatggacaaagcccaggtgggcattgccagcatgggctatgatggaaacacctgcaacatgcacctgaatgatctggccaaaattgtaaaagaaggtgtctggaaaaatgatatggtgggattaaccttcagcaccattggcgtaagtgacggtatgtcgaacggaacagatggcatgcgttactccctggtttcaagagatgtaattgccgattctattgaaactatctgcggtgggcagtattatgatggtttgatcaccattcctggctgtgataaaaatatgccaggttctgttatggccatgggccgtttaaaccgcccttctattatggtatatggcggcagtatccattcgggtaaatggaagggacaatcattaaacattgtatctgcttttgaagcattgggccagaaacttgccggcaatttagaagaagaggattttcagggtgtaattaaaaatgcatgtccgggtgctggtgcctgtggtggtatgtataccgcaaataccatggcttcggctattgaggctttaggaatgagtttgccttacagctcttcccacccggccacaagtgatgaaaaaaagaacgaatgcctggaagcaggtaaatacatccgtatcctgctggaaagaaatatcctgccttcggatatcatgaccgagaaagcatttcgcaatgcaatcgtaattgtgatggtactgggcggatctacaaatgcagtactgcacctgattgccattgccagatctgtaggtatagacctgaaactggatgatttccagcacatcagcgacagcaccccggtactgggcgacttaaaaccaagcggaacttacctgatggaagatctgcatgaaataggtggtgtacctgcggtaatgaaatatttgttaaaagtgggtttaattgatggcgactgtataactgtaaccggaaaaaccattgctgaaaatgttgctgatgcggcagacctggattttgaaacccaaaagattattttccctatagaaaaccctattaaagaaaccggccacttacaaatgttatatggcaacctggctaccaaaggggctgttgcaaagatcagtggtaaggaaggagagagatttactggcccggcacgcgtatttgacggagagaaatcgctgatggcaggtatacagagcggacgcctgaaaagtggggatgtagtagtgatcagacaggttggccctaaaggcgcccctggaatgccagagatgttgaaacctacttcattgattattggcgcaggtttgggtaaatcagtagccctgattactgacggtcgtttttctggtggtacacatggttttgtggtaggccacatcactcctgaagcatgggatggcggaaacattgccctggtacatgacgatgacatcattactatagatgcagtaaacaattctatagatgtacacctgactgatgagcagctggcaacccgccgcgcggtatggaaacaacttccgccacccgtcaccaaaggtgtgctttacaaatacctgaaacaagtaagcaatgccagtgaaggctgcgttactgatgcctatacagattaa

SEQ ID NO: 525 - protein, 567 aa, Microcoleus chthonoplastes
MSDNLRSQVVTQGVQRSPNRAMLRAVGFSDRDFTKPIVGLANGYSTITPCNMGINDLALRAEAGLKQAGAMPQVFGTITISDGISMGTEGMKYSLVSREVIADSIETVCNGQSMDGVLAIGGCDKNMPGAMIAIARLNIPAIFVYGGTIKPGHLDGQDLTVVSAFEAVGQHSAGKITEEQLVAVERNACPGAGSCGGMFTANTMSSAFEAMGMSLPYSSTMAAEDAEKADSTEKSAFVLVDAIRQQILPKQILTRQAFENAISVIMAVGGSTNAVLHLLAIARAIGVELSLDDFETIRAKVPVLCDLKPSGRYVATNLHQAGGIPQVMKMLLVHDLLHGEALTITGQTLAEVLADVPEEPPSDQDVIRPWDNPMYTQGHLAILKGNLATEGAVAKITGVKTPQITGPARVFESEEACLDAILAGKIQAGDVIVVRYEGPKGGPGMREMLAPTSAIIGAGLGDSVGLITDGRFSGGTYGMVVGHVAPEAAVGGAIALVEEGDSITIDAPARLLQINISDQELQQRRAKWQPAKPRYTKGVLAKYAKLVSSSSLGAVTDFESVMNQITE

SEQ ID NO: 526 - DNA, 1704 bp, Microcoleus chthonoplastes
atgtcagacaacctgagaagtcaagtcgttacccaaggtgtgcaacgatcgccaaatcgtgccatgcttcgtgctgtcggttttagcgatcgcgattttactaagccaattgttgggttagcgaatggttatagtacaatcacgccctgtaatatgggcatcaatgatttagcgctaagggcagaagccggactgaaacaagcgggggcgatgccgcaagtctttggtactattacgattagcgatggtatctctatgggtactgaggggatgaaatattccctggtgtcacgggaagtgattgctgactccatcgaaaccgtctgtaatggtcaaagtatggacggggtgctggcaattggtggctgtgataagaatatgcccggggcgatgattgcgatcgcgcggctgaatattcccgctatttttgtctatgggggaacgattaaacccggacatctggatggacaagatttaaccgttgtcagcgcctttgaagcagtgggacaacatagcgcgggtaagattacagaagaacaactggtagccgtcgaacgaaatgcttgtcctggtgcgggttcttgtggggggatgttcacggctaacactatgtcctcggcatttgaagccatggggatgagtttaccctattcctcgacgatggcggcggaagatgccgaaaaagcagatagtacggaaaaatcggcgtttgttctggttgatgcgattcgtcagcaaatcctgcctaagcagattttaacccgccaagcctttgaaaatgccatctcggtaattatggcagtgggtggatcaacgaatgcggtactgcatttactggcaattgcgcgggcgatcggggtagagttatccctggatgactttgaaaccattcgtgctaaagttccggttctgtgtgatcttaaacccagtggcagatatgtagcgacaaacttacatcaggcgggtggtattccccaagtgatgaaaatgctgctggttcatgatttgttacatggtgaggcattaacgattacggggcaaaccctagcggaagtcttagccgatgtacctgaggaaccaccctcagatcaagatgtgattcgtccctgggataatcccatgtatactcaaggacatttggcgattttaaaaggaaatttggcaaccgaaggtgcggtggcgaagattacaggcgtgaaaaccccccaaattacgggtccagcacgagtctttgaatccgaggaagcctgtctggatgcaattttggcgggtaagattcaagctggagatgtgattgtggtgcgttatgagggacccaaaggaggtccgggaatgcgggaaatgttagcgccaacctcagcaattattggtgctggcttaggggattccgtgggattaattaccgatggtcgcttttctggtgggacctatggtatggtggtcggtcatgttgccccagaagccgccgttgggggtgcgatcgcgttagtcgaagaaggggattcgattacgattgatgctccggcgcgattattacagattaatatatccgatcaggaactgcaacaacgccgcgccaagtggcaacctgccaaaccccgatataccaaaggagtgctggcgaagtatgccaaattagtgtcttctagcagtttgggtgcggtgacagattttgaatcggtgatgaatcagataacggagtga

SEQ ID NO: 527 - protein, 567 aa, Acidimicrobium ferrooxidans
MERRQLKVRSRDVTEGPTRAPARAMLRAVGLVEEDFDKPQIAVASSWNEVTPCNLPLGELAKRVKAGVRSAGGVPLEFATIAVSDGISMGHEGMHSSLVSREVIADSVELMVHAERMDGLVTLAGCDKSLPGMMMAAARLDLASVFVYGGSILPGHLKDQRLDIVSVFEAVGAYAAGQISQDELSAIERNACPTPGSCAGMYTANTMASVSEALGLAPLGSASAPAVDRRRADAAFEAGELVMRQLELGITARRILTKEAFENAIATVMALGGSTNAVLHLMAIANEARVELRLDDFNRIAARVPHLADTKPHGKFYMTDIDRVGGVPVVLRELAEAGLVHTDVLTATGRTLGDELDAYDPPAADGVVIHRLDDPIHAVGGIAVLTGSLAPRGSVVKVAGIDQDVFEGTARVFDREEAALTAILAGEIRAGDVVVIRYEGPKGGPGMREMLAVTGAMKGAGRGSDAALVTDGRFSGGTHGLCVGHVAPEAADGGPIALVRDGDRIRIDVPNHAIDLLVAPDELERRRASFAPLPPRYTSGALAKFAALVRGADVGAVTSAGFDDDSR

SEQ ID NO: 528 - DNA, 1704 bp, Acidimicrobium ferrooxidans
gtggagcggcggcagctgaaggttcggagccgggacgtcaccgaggggccgacgcgagcaccagcgcgcgcgatgcttcgcgcggttgggctggtcgaggaggacttcgacaagccgcagattgcggtcgcctcatcgtggaacgaggtgacaccatgtaatttgccgctcggtgagctcgccaagcgggtcaaggctggcgtgcggtcagccggcggcgtgccgctcgagttcgcaaccatcgcggtatcggacggcatctccatgggtcatgaggggatgcactcgtccctcgtgtcgcgcgaggtcatcgcggattcggtggagctcatggtgcacgccgagcgcatggacggactcgtgacgcttgccgggtgcgacaagtcgctccccggcatgatgatggccgcggcacggctggacctagcgagcgtgttcgtctacggcggctccatcctcccgggtcatctgaaggatcagcggctcgacatcgtctcggtgttcgaggcggtcggtgcatatgctgccggacagatcagccaggacgaactgagcgcgatcgagcgcaacgcgtgcccgacgcccggttcgtgcgcgggtatgtacaccgccaacaccatggcctcggtgtccgaagcgctgggcttggcgccgctcgggtcggcgtccgcgccagcggtggatcgccgtcgtgcagacgcggcgttcgaggcgggcgaactcgtcatgcgccagctcgagctcgggatcacggcgcgacgcatcctcaccaaggaggccttcgagaacgccatcgcaaccgtcatggcgctcggcgggtcgacgaacgccgtcttgcacctgatggcgatcgcgaacgaggcccgtgtcgagctgcggctcgatgacttcaaccggatcgccgcgagggttccgcacctcgccgacaccaagccgcacggcaagttctacatgaccgacatcgaccgcgtcggcggggtcccggtcgtgctgcgtgagctggccgaggcgggtctcgtccacaccgacgtactcacggccacggggcgaaccctcggtgatgaactcgatgcgtatgatccgccagcggccgatggagtcgtgattcaccgtctcgacgacccgattcatgccgtcgggggtatcgccgtgctgacgggaagcctcgcgccgcgcggatcggtcgtgaaggtggccggcatcgaccaggatgtcttcgaggggacggcccgggtgttcgaccgcgaggaagctgccctgaccgccatcttggccggggagatccgcgctggcgacgtcgtcgtgatccgctacgagggcccgaagggcgggcccggcatgcgcgagatgctcgccgtgaccggtgcgatgaagggggcgggacgcggttcggacgcggcgctcgtcaccgacggtcgcttttcggggggcacccatggactgtgcgtcggtcacgtggctcccgaggccgccgacggcggcccgatcgcgctcgtgcgcgacggggaccggattcgcatcgacgtcccgaaccatgcgatcgatctactcgtcgccccggacgagcttgagcgacgacgagcgtcgttcgcgcccttgccccctcgctacacgagcggtgcgctcgcgaagttcgcggcgctcgtgcgcggtgccgatgttggggcggtgacctcggcaggattcgacgacgactcgcgctag

SEQ ID NO: 529 - protein, 607 aa, Rhodobacterales bacterium
MRLATLPLLIYPLSNAYFGEPAMTKFDKSKLPSRHVTEGPARAPHRSYYYAMGMSEEEIHQPLVGVATCWNEAAPCNISLNRQAQAAKMGVKAASGSPREFTTITVTDGIAMGHEGMRSSLASREAIADTVELTMRGHCYDALVGLAGCDKSLPGMMMAMIRLNVPSVFVYGGSILPGRAPAGAKVPEAYADRDLTVQDMFEAVGHQQNGTMTEAELEILERVACPSSGACGGQFTANTMACVSEAIGLALLNSSGAPAPFESRDEYSKASGIAVMNLIEKGIHARDVCTREAFENAARVVACTGGSTNAGLHLPAMAHEAGIDFYLEDVCDIFRDTPYFVDLKPGGQYVAKDLYEAGGVPVVLNELRRAGLLHEDCMTATGYSIGEELDMHTLKADGRVVYPVETPITKTGGVVGLKGNLAPEGAIVKVAGMAAQHQRFVGPARIFECEQDAFEAVQNRTYKEGDVFVIRNEGPAGGPGMREMLATTAALSGQGMGLKVALITDGRFSGATRGFCVGHVGPEAAHGGPIALLQQGDVITLDAVEGTLDVDISDEEMAKRRADWKGPRETIYASGALWKYADQVGEIYKGAVTHPGGKAEKHAYWDL

SEQ ID NO: 530 - DNA, 1824 bp, Rhodobacterales bacterium
ttgcgccttgcgaccttgcctttgctgatttatccactctccaacgcatatttcggagagcccgctatgaccaagttcgacaaaagcaaactgccaagccgccatgtcacagaagggccagcgcgcgcgccgcaccgttcgtattattacgcgatgggcatgtctgaggaagaaattcaccagcccctggtaggtgttgccacatgctggaacgaagccgcgccgtgcaacatttctttgaaccgtcaagcacaggccgcaaagatgggtgtcaaagccgcctctggcagcccgcgtgagttcacgaccatcaccgtcacggacggcattgcaatgggtcatgagggcatgcgcagctccttggcgtcacgtgaagcgattgctgatacggttgaattgaccatgcgtggtcactgctacgacgcgcttgtgggccttgcaggctgtgacaaatccttgccgggcatgatgatggcgatgatccgtctcaacgtgccgtccgtgtttgtctacggtggctccatcctgccgggtcgcgcacctgccggcgcgaaggttccagaggcctatgcagatcgcgatcttacggttcaggacatgtttgaagccgtgggccatcagcaaaacggcacaatgaccgaagcagagctggaaatcctagagcgtgtggcttgcccatcttctggcgcatgtggtggccagttcaccgccaacacgatggcctgtgtgtccgaggcgattggccttgcgttgctgaattcctccggtgcccctgccccgttcgagagccgtgatgaatactccaaagcctccggcattgccgtgatgaacctgattgaaaaaggcattcacgcacgcgacgtctgcacacgcgaagcgtttgagaatgcagcgcgtgttgttgcttgtacgggcggctccacgaatgcgggcctgcaccttcctgcgatggcgcatgaagcgggcattgatttctatcttgaagatgtttgcgatatttttcgcgacacgccttatttcgtcgatctcaagcccggtggtcagtatgtcgccaaagatctctatgaggcgggcggcgttcccgttgtcttgaacgaactgcgccgtgctggcttgctgcatgaagactgcatgaccgcgacgggctattccattggtgaagaactcgacatgcacacactgaaggctgatggccgcgtggtttatcccgttgaaacgccaatcactaagacgggtggcgttgtgggtctcaagggcaacctcgccccagaaggcgcaattgtgaaggttgcaggcatggcagcacagcaccagcgtttcgtcggccctgcccgcatctttgaatgcgagcaagacgccttcgaggcggttcaaaaccgtacgtataaagagggcgatgttttcgtgatccgtaacgagggccctgcaggcggtccgggcatgcgcgaaatgttggcaacaacagctgcgctttccggtcagggcatgggtctgaaggtagcactgatcactgacggtcgtttctctggcgcaacccgtggcttctgtgtgggtcacgttggtcccgaagctgcacatggcggtccgattgccctgctccagcaaggtgacgtgatcacgcttgatgcggttgaaggtacgttggacgtggatatttctgacgaagagatggccaagcgccgtgccgattggaaaggcccgcgtgagacgatctatgcctctggcgcgctttggaagtatgcggatcaagttggcgagatctacaagggcgcggtcacgcatcctggcggcaaggcagaaaagcatgcgtattgggatctgtga

SEQ ID NO: 531 - protein, 572 aa, Candidatus Pelagibacter sp
MAKFNKKKLPSRHTSLGADRAPHRSFYYAMGETEKDVAKPFVGVVSTWNEAAPCNIALMRQAQSVKKGVRANGGTPREFCTITVTDGIAMGHEGMKSSLISREVIADSAELTVRGHCYDALVGIAGCDKSLPGLMMSMVRLNVPSVFIYGGSILPGRYKGKDVTVVDVFEAVGKHSSGQMSAVELRKLELVACPSAGACGGQFTANTMACVSEAIGLALPYSAGTPAPYEERDKYAKESGKTVMNLLQKGIKPRDIVTKKALENAATIVAATGGSTNAGLHLPAIANEAGIKFDLMDVAKIFKRTPYLADLKPGGKYVAKDMWLAGGVPMLLKTLYEGGFIHGDCMTVTGKTMKENLKNIKFNPKQKVMRSYKDPLSPTGGVVGLKGNLAPEGAIVKVAGLKKLQFTGKARCFDNEESAMKAVQSKKYNDGDVIIIRYEGPVGGPGMREMLSTTGAIYGQGKGEKVALITDGRFSGATRGFCVGHVGPEAALGGPIGLLRTGDIIDIDAKKGTIDVRLSKKELASRKRNWKARKSDFGSGTLWKYAQTVGPAYLGAPTHPGKKKEVKDYSEI

SEQ ID NO: 532 - DNA, 1719 bp, Candidatus Pelagibacter sp
atggcaaaatttaacaagaagaaacttccaagtagacatacatcgttaggagcagatagagctcctcatagatcgttttattatgcaatgggcgaaactgaaaaagatgtggcaaaaccgtttgtaggtgttgtatcaacttggaatgaagctgctccttgtaatattgctcttatgaggcaggctcaatctgttaaaaaaggagtgagagctaatggaggaactccaagagaattttgtacaattacagtaacagatggtattgcaatgggtcatgaaggaatgaaatcttctttaatttccagagaagtgatcgcagactctgctgaactcactgtaagaggacactgttatgatgctctagtcggtattgctggatgtgataaatcattaccaggattaatgatgtctatggttagattaaacgttccaagtgtttttatttatggaggatcaattcttccagggagatataaaggtaaagatgtaactgttgttgatgtatttgaagctgtaggaaagcattcatcaggtcaaatgtctgcagttgaacttagaaaactagaattagttgcttgtccaagtgctggtgcttgtggtggtcaatttacagcaaacactatggcatgtgtatctgaagcaattggtttagcacttccttattctgcaggaacaccagctccttatgaggaaagagataaatacgcaaaagaaagtggtaagacagttatgaacttacttcaaaaaggaattaaaccaagagacattgtaaccaaaaaagcattagagaatgctgctacaatagttgctgcaactggtggatctactaatgcaggattacatttgcctgctattgcaaatgaagcaggaattaaatttgatttaatggatgttgctaaaatttttaaaagaactccttatcttgcagatttaaaaccaggtggaaaatatgttgcaaaagatatgtggttagcaggtggtgtgccaatgcttttaaaaactttatatgaaggtggttttattcatggagattgcatgactgttactggtaaaaccatgaaagaaaatttaaaaaatattaaatttaatccaaaacaaaaagtgatgagatcttacaaagatcctttatcacctacagggggagttgttggcttaaaaggtaatttagctcccgaaggtgcaattgttaaagttgcaggattaaaaaaattacaatttactggtaaagcaagatgctttgataatgaagaaagtgcaatgaaagcagttcaaagcaaaaaatataatgatggtgatgtgatcataattagatatgagggtccagtaggtggtcctggtatgagggaaatgctatcaacaacaggtgcaatctacggacagggaaaaggggagaaagtagctcttattacagatggtaggttctctggtgctacaagaggcttctgtgttggtcacgtaggccctgaggccgctctagggggtcctataggcctattacgtactggtgatatcattgatatcgatgccaaaaaaggaactatcgatgtaagactatctaaaaaagaattggcttcaagaaagagaaattggaaggctagaaaatcagactttggatctggcacattgtggaaatatgcacaaactgttggtccagcttatttaggagcaccaactcatccaggtaagaaaaaagaagtcaaggattattcagaaatttaa

SEQ ID NO: 533 - protein, 559 aa, Chitinophaga pinensis
MELNKYSKTLTQDPTQPATQAQLYALGLTEEDLKKAQVGIASMGYDGNPCNMHLNDLAQEVKKGVWANNLVGLTFHTIGVSDGMTNGTPGMRYSLVSRDLIADSIETVVGAQYYDGVITVPGCDKNMPGSLIAMGRLNRPSIMVYGGSTAPGKYQGKDLNIISAFEALGQKMAGQLSDEDFKGIVQHSCPGAGACGGMYTANTMSSAIEALGMSLPYSSSNPALSKDKKEECLSAGKYIHILLEKDIKPSDIMTLEAFENAATVVMALGGSTNAVLHFIAIAKAIGVKFGLPEFQRISDKTPLIADLKPSGKYLMEDLHNIGGVPLVMKYLLKKGYLHGHCLTVTGKTLAENLESVPDLEFEGQDIVVPVEKPIKATGHIQMLYGNLAELGSVAKITGKEGLSFRGPARVFEGEYELIAGIQNGRVKAGDVVVIRQVGPKGAPGMPEMLKPTSAIMGVGLGKSVALITDGRFSGGTHGFVVGHITPEAVEGGTIGLVQDNDIIEIDAEKNTINVELSAEELAARRAKWVKPALKVTNGVLYKYAKLVSNATEGCVTDEA

SEQ ID NO: 534 - DNA, 1680 bp, Chitinophaga pinensis
atggaattaaacaaatacagcaaaacgctcacgcaggatccaacacagcccgccacacaggcgcagctgtacgcactcggtttaactgaagaagacctgaagaaagcgcaggtaggcattgccagtatgggctatgacggtaatccatgtaacatgcacctcaatgacctcgctcaggaggtcaagaaaggggtctgggctaataatctggtcggactcactttccatactattggcgtcagcgatggtatgacaaatggtactccgggtatgcgttattccctggtcagccgcgacctgattgctgattccatcgaaaccgttgtaggcgctcagtattatgatggtgtgatcaccgtacctggctgtgataaaaacatgcctggctccctgatcgcgatgggacgtctgaatcgtccttctatcatggtatatggcggttctacagctcctggtaaataccagggaaaagacctgaacattatctctgcatttgaagcgctgggtcagaaaatggctggtcagctcagcgatgaagacttcaaaggcattgtacagcattcctgccctggcgccggcgcctgtggcggtatgtatacggcaaataccatgtcttctgctattgaagcattaggtatgagccttccttatagttcttctaaccctgcactcagcaaggacaaaaaagaagaatgtctgtcagctggtaaatatatccacatcctcctggagaaagatatcaagccttctgatatcatgacgctggaagcatttgaaaatgcggctaccgttgtgatggcactgggtggtagtaccaatgccgtactgcacttcattgcaatcgcaaaggcaataggcgtgaaattcggattacctgaattccagcgtatcagcgataaaacaccactgatcgctgacctgaaaccaagtggtaaatacctgatggaagacctgcacaacattggcggcgttccattagtaatgaaatatctgctgaaaaaaggctacctgcatggtcactgtctgacagtaaccggcaagaccctggcagaaaacctggaaagtgtaccagatctggaattcgaaggacaggatatcgttgttccggtggaaaaaccaataaaagcgactggtcacatccagatgctgtatggtaacctggcagaactgggttccgtagccaagattaccggtaaggaaggactgagcttccgtggtcctgcgcgtgtgtttgaaggtgaatatgaactgatcgcaggtattcagaacggtcgtgtgaaagcaggcgatgtggtggtaatcagacaggtaggtccaaagggcgcacctggtatgccggaaatgctgaaaccaacatccgctatcatgggtgtaggtcttggtaagagcgtagcgctgattacagacggacgtttctctggtggtacacacggttttgtagtaggacacatcacaccggaagcggtagaaggtggtactatcggactggtacaggacaatgacataatagaaattgacgccgaaaagaatacaatcaacgtggaactgagtgcagaagaactggctgcccgcagggcgaaatgggtaaaacctgcgttgaaagtaactaatggtgtattatataaatatgcaaaactcgtttcaaatgcaacagaaggatgtgttaccgatgaagcctga

SEQ ID NO: 535 - protein, 561 aa, Alcanivorax sp.
MSDSKDDPRRRHSAKVVDGPGKSASRAMLRAVGFTDEDFHKPQVGIASTWSQVTPCNSHIGELADKACEGADAAGGKGVIFNTITISDGIANGTEGMKYSLVSREVIADSIETVAACEGFDGLVTLGGCDKNMPGCLMGMARLNRPSVFVYGGTIMPGKGHTDIVSVFEAMGAHSRGDMDLIELKQIEETAIPGPGSCGGMYTANTMASAIEALGMSLPGSSAQNAVSEEKREDCVRAGAAVLKLLEQDIKPSDIMTRAAFENAITVVIALGGSTNAVLHLIAMARTVGVALSLDDFTEIGKRVPVLADLRPSGHYMMSELVAIGGIQPLMKILLEAGLLQGDCLTVTGRTLAENLADVAPYPLDQSIIAPLSEPLKAESHLRILYGNLAPDGAVAKITGKEGTHFSGPARVFGSEEEAQQRINDGTVVSGDVVVIRYEGPRGGPGMREMLTPTSAIMGRGLGNEVALITDGRFSGGSHGFVVGHVTPEAFDGGPLALLEDGDLITIDAQDNTLVVDLSDAELARRRANWKQPAPRYTRGVLAKYARLVGSASEGALTDQD

SEQ ID NO: 536 - DNA, 1686 bp, Alcanivorax sp.
atgagtgactcaaaggacgatccgcgtcgccgccattcagcaaaggtcgttgatggccccggtaaatccgccagccgggccatgctgcgggcggtgggatttaccgatgaggatttccacaaacctcaggtggggatcgcgtccacctggagccaggtgacaccctgcaacagccacattggtgagctggccgacaaggcctgcgaaggggctgatgcggccggcggcaagggcgtgatttttaacaccatcactatttccgatggcatcgccaacggcaccgaagggatgaagtattcgctggtctcccgcgaggtgattgccgactccattgaaaccgtggcggcctgtgaagggtttgacggcctggtgaccctgggcggctgcgacaagaacatgcccggttgcctgatgggcatggcgcggctgaatcgccccagtgtgttcgtctacggcggcaccatcatgcccggcaaggggcacaccgatattgtctccgtgttcgaagccatgggcgcccattcccggggcgacatggatctgatcgagctcaagcagattgaagaaaccgccatccccggcccgggctcctgtggcggcatgtacaccgccaacaccatggcctcggccatcgaagcgctgggcatgagcctgcccggcagctcggcacagaacgcggtgtccgaggaaaagcgggaagattgcgtgcgggccggcgccgctgtattaaaactgctggaacaggacatcaaaccgtccgacatcatgacccgcgcggcgttcgagaatgccatcaccgtggtgattgctctgggcggctccaccaatgcggtgctgcacctgatcgccatggcgcgcaccgtgggcgtggcgctgtcactggatgacttcaccgaaatcggcaagcgggtgccggtgctggcggacctgcgccccagtggccactacatgatgagcgaactggtggccattggcggtattcagccgctgatgaaaatactgctggaggccggattattgcagggcgattgcctgacggtgaccggccgaacgctggcggaaaacctggccgatgtggcgccctatcccctggatcaatccatcattgcgcccctgtccgagcctctgaaagcggaaagtcacctgcgcattctctatggcaacctggcgccggacggcgcggtagcaaaaatcaccggtaaggaaggtactcatttttccgggccggcacgggtgttcggttccgaagaagaagcccagcaacggattaacgacggcacagtggtgtctggcgacgtggtagtgattcgctatgaaggcccccgcggtgggccgggcatgcgtgaaatgctcacccccacctctgccatcatggggcgcggcctgggcaatgaggtggcgctgatcaccgatggccgcttctccggcggcagtcatggttttgtggtcggccacgtgaccccggaagcgttcgatggcggcccgctggcgctactggaagacggcgacctgatcaccattgatgcgcaggataacaccctggttgtggatctctccgatgcggagctggcacgccggcgagccaattggaagcaaccggcaccacgctatactcgtggcgtgttggccaaatacgcacggctggtcggctccgccagcgaaggcgcgctgacggatcaggactga

SEQ ID NO: 537 - protein, 575 aa, Micrococcus luteus
MDSAASTPSTPSAAPDMKPRSRDVTDGMERTAARGMLRAVGMGDEDFGKPQIGIASSWNEITPCNLSLDRLAQASKDGVHAAGGYPLEFGTVSVSDGISMGHEGMHFSLVSREVIADSVETVMMAERLDGSVLLAGCDKSLPGMLMAAARLDLASVFVYAGSIMPGVARLTDGTERQVTIIDAFEAVGACARGLMSEEDLLRIEKSIAPGEGACGGMYTANTMASIGEALGMSLPGSAAAPSADRRRDAFARRSGEAVVNMLRQGITARDIMTKPAFENAIAVTMAFGGSTNAVLHLLAIAREAGVDLQLSDFNRVADRTPHIADLKPFGQYVMTDVDRIGGVPVVMKALLDEGLLHGDTLTVTGKTLAENLAALDPDPVDGKVIRTMDDALHPNGGIAILHGSLAPEGAVVKSAGFDADVFEGTARVFDRERAAMDALEDGTIAAGDVVVIRYEGPKGGPGMREMLAITGAIKGAGLGKDVLLITDGRFSGGTTGLCIGHIAPEAAEGGPIGLVQDGDRIRVDIAGRTMDLLVDEAELAARLESWEPVAPKFTTGVLGKYAKLVHSAAEGAYLG

SEQ ID NO: 538 - DNA, 1728 bp, Micrococcus luteus
atggactccgccgcgtcgactcccagcaccccgtccgccgcccccgacatgaagccgcgctcgcgcgacgtcaccgacggcatggagcgcaccgccgcccgcggcatgctccgcgcggtcggcatgggggacgaggacttcggcaagccgcagatcggcatcgcctcgtcctggaacgagatcaccccctgcaacctctccctggaccgcctcgcccaggcctcgaaggacggtgtccacgccgccggcggatatccgctggagttcggcacggtctccgtctcggacggcatctccatgggccacgagggcatgcacttctccctcgtctcccgcgaggtgatcgccgactcggtggagaccgtgatgatggccgagcgcctggacggctccgtcctgctcgccggctgcgacaagtcgctgccgggcatgctcatggccgccgcccgcctggacctggcctccgtgttcgtctacgccggctcgatcatgccgggcgtcgcccgcctgaccgacggcaccgagaggcaggtgaccatcatcgacgccttcgaggcggtcggcgcctgcgcccgcggcctcatgtccgaggaggacctgctccgcatcgagaagtccatcgccccgggcgagggcgcctgcggcggcatgtacaccgccaacaccatggcctccatcggcgaggccctcgggatgtccctgcccggttccgccgccgccccctccgcggaccgtcgccgtgacgccttcgcgcgccgctccggcgaggccgtggtgaacatgctccgccagggcatcacggcccgggacatcatgaccaagcccgcgttcgagaacgcgatcgccgtgaccatggccttcggcggctccaccaacgccgtgctgcacctgctcgccatcgcccgggaggcgggcgtcgacctgcagctgtccgacttcaaccgcgtcgccgaccgcaccccgcacatcgccgacctcaagccgttcggccagtacgtcatgacggacgtggaccgcatcggcggcgtccccgtggtcatgaaagccctgctggacgagggtctgctgcacggggacaccctcaccgtcaccggcaagaccctcgccgagaacctggcagcgctcgatccggacccggtggacggcaaggtcatccgcaccatggacgacgcgctgcaccccaacggcggcatcgcgatcctccacggatcgctggccccggagggcgccgtcgtgaagtccgccggcttcgatgcggacgtcttcgagggcaccgcgcgcgtcttcgaccgtgagcgcgccgccatggacgccctcgaggacgggaccatcgccgccggcgacgtcgtggtcatccgctatgagggcccgaagggcggcccgggcatgcgcgagatgctcgcgatcaccggcgccatcaagggggcggggctgggcaaggacgtcctgctgatcaccgacgggcgcttctccggcggcaccaccggcctgtgcatcggccacatcgcccccgaggccgccgagggagggccgatcggcctggtgcaggacggcgaccgcatccgcgtggacatcgccggacgcaccatggacctgctcgtggacgaggccgagctcgccgcccgcctcgagtcctgggagccggtggcgccgaagttcaccacgggcgtgctgggcaagtacgccaagctggtgcactccgccgccgagggcgcctacctgggctga

SEQ ID NO: 539 - protein, 564 aa, Verrucomicrobiae bacterium
MSDQVKSTRPHSAALVDGHDRAPARSMLRAVGFTDEDFKKPQIGIASTGSDLTPCNMHIDELAEHATKGASEGGGKPVNFSTITISDGISMGTKGMRYSLVSREVIADSIETVMAGESIDGLVAIGGCDKNMPGCMIALARLNRPAIFVYGGSILPGLHKEKPVDIVSVFEAVGRHAKGEIDDAELKDIESCAIPGAGSCGGMYTANSMATAIEALGMSLPGSSAQLAVGQEKREDCVNAGKQVNKLLELDLKPRDIMTKAAFENAIKTCIALGGSTNIILHLLAIAHAADVDLSIDDFERLGEQIPLLADVKPFGKYNMSHLIRIGGIQPMMKILLDRGLLDGSCITVTGKTVAENLKDVQPYSKDQDIIRDWDNPIKSTSHLRVLRGNLAPTGAVGKITGKEGLHFKGTAKVYENEEDSLEGILRGDVVAGDVVVIRNEGPVGGPGMREMLSPTSAVAGKGLIMDVALITDGRFSGGSHGFDVGHITPEAACGGPIGIVKTGDEIEIDAVKNTISLNIPQDEYDARMAAFVPSGPGEKRGVLGKFAKLTASASEGAVSDKYL

SEQ ID NO: 540 - DNA, 1695 bp, Verrucomicrobiae bacterium
ttgagcgaccaagtaaaatccacccgccctcactccgcggccctcgtcgatggccacgaccgcgccccagcccgctccatgctccgcgccgtcggcttcacggacgaagatttcaaaaagccccaaatcggcatcgcctccaccggcagcgacctcaccccgtgcaacatgcacatcgacgagctcgccgaacacgccaccaaaggcgccagcgaaggcggcggcaaacccgtaaacttctccaccatcaccatttccgacggcatctcaatgggcaccaaaggcatgcgctacagcctcgtttcgagagaagtcatcgccgactccatcgaaaccgtcatggcaggcgaaagcatcgacggactcgtcgcgatcggtggttgcgacaaaaatatgccgggctgcatgatcgccctcgcccgcctcaaccgccccgccattttcgtctacggcggatccattcttcccggcctccacaaggaaaagcccgtcgatatcgtctccgtcttcgaagccgtcgggcgacacgccaaaggcgagatcgacgacgccgagctcaaggacatcgagtcctgcgccatcccgggcgccggatcctgcggcggcatgtataccgccaattccatggccaccgccatcgaagccctcggcatgtcgctgccgggctcctcggctcagctcgccgtcggacaagaaaaacgcgaggactgcgtcaacgccggcaaacaggtcaacaagctcctagagctcgacctcaagccacgcgacatcatgaccaaggcggccttcgaaaacgccatcaagacctgcatcgcgctcggcggttcgaccaacatcattcttcacctcctcgccatcgcccacgcagcggacgtcgatctctccatcgacgacttcgaacgcctcggcgagcaaattcccctcctcgcggacgtgaagcctttcggcaagtacaacatgtcccacctcatccgcatcggcggcatccagccgatgatgaagatcctcctcgaccgcggactgctcgacggctcctgcatcaccgttaccggcaaaaccgtcgccgaaaacctgaaagacgtacagccgtattcgaaagaccaggacatcatccgcgattgggataatcccatcaaatccacttcccacctccgcgtcctccgcggaaacctcgctcccaccggtgccgtcggcaaaatcaccggcaaggaaggactccactttaagggcaccgccaaagtctacgaaaacgaagaagactctctcgaaggtatcctgcgcggcgacgttgttgcaggcgacgtagtcgtcatccgcaacgaaggtcccgtcggcggtcctggcatgcgcgaaatgctttccccgacttccgcagtcgcgggcaaaggacttatcatggacgtcgccctcatcaccgacggacgcttctccggaggctcgcacggcttcgacgtcgggcacatcactccggaagccgcgtgcggcggaccgatcggcatcgtcaaaaccggcgacgaaatcgaaatcgacgccgtcaaaaacaccatctcgctcaacattccgcaagacgagtacgacgcccgcatggccgcattcgtcccctccggcccgggcgagaaacgcggcgtcctcggaaagttcgccaagctcaccgcctccgcctcagaaggagccgtcagcgacaagtacctctga

SEQ ID NO: 541 - protein, 561 aa, Synechococcus sp.
MSDNRKSQVVTQGVQRAPNRAMLRAVGFQDGDFKKPIVGLANGYSTITPCNMGINTLAIRGEAALKEAGAMPAMFGTITISDGISMGTEGMKYSLVSREVIADSIETACTGQSMDAVLAIGGCDKNMPGAIIAIARMNIPSIFVYGGTIKPGHLDGEDLTVVSAFEAVGQYSAGKIDKERLDAVERHACPGAGSCGGMFTANTMSSAIEAMGLSLPGSSTMAAEDEEKAVSTEKSAFALVEAVRKQILPKDILTRKAFENAIAVIMAVGGSTNSVLHLLAIAHTIGVKLTIDDFEAIRNKVPVFCDLKPSGRYVATDLHKVGGIPQVMKMLLNEGLLHGNALTISGQTIAETLADIPDHPPTDQDVIRPFNQPMYAQGHLGILKGNLAPEGAVSKLTGIKNRSITGPARVFESEEECLDAILANKIKAGDVIVVRYEGPKGGPGMREMLAPTSAIIGAGLGDSVGLITDGRFSGGTYGMVVGHVAPEAAVGGTIGLVKEGDSITIDADKLLLQVNVADEELAQRKSQWSPPQPRYDRGVLAKYAKLVSSSSKGAVTDKDLF

SEQ ID NO: 542 - DNA, 1686 bp, Synechococcus sp.
atgtcggataatcgcaaaagtcaggtagtcacccaaggcgttcagcgggctcctaaccgagcgatgctgcgagctgtcggcttccaagatggtgattttaaaaagccaattgtcggccttgccaatggctatagcaccatcacgccttgcaatatgggcatcaataccctggcaattcgcggcgaagccgcactaaaagaagcaggtgcaatgcccgcaatgtttggcaccatcaccatcagcgacggcatttcgatgggaacagaggggatgaagtactccttggtttctcgtgaggtgattgccgattcgattgagaccgcctgcactgggcagagcatggacgcggtgctagcaattgggggctgcgacaagaatatgccaggagcgattattgcgatcgctcggatgaatattccttctatttttgtctacggcggcacgatcaaacccggtcatttagacggcgaagatctaactgttgtcagtgcctttgaagcagtcggtcaatacagtgctggcaaaattgataaagagcgactagacgcggtagagcgacatgcttgtccgggggcgggttcttgcggtggcatgtttaccgcgaacaccatgtcttctgcaatcgaagcgatgggcctgagtttgccgggttcttcgaccatggctgcagaggatgaggaaaaggcggtcagcactgagaaatctgcctttgccctcgttgaagcagttcgcaagcagattttgcccaaggacatcttgacgcgaaaggcattcgaaaatgcgatcgcggtgattatggccgtaggcggatcgaccaattcggttttgcacttgcttgcgatcgcccacactatcggcgtaaaactgaccattgacgacttcgaggcaattcggaacaaagttcccgtcttctgcgacctcaagccttcaggccgctacgtcgccactgacttgcataaagtgggtggcattccccaggtgatgaaaatgctgctaaacgaagggctgcttcacggcaacgcgctcaccatcagcggccaaaccatcgccgagactttggccgatatccctgaccatccccccaccgaccaggatgtgatccgccccttcaaccagccgatgtatgcccaagggcaccttggcatcctcaaaggcaatctcgcccccgaaggcgcagtctccaaacttactggtatcaaaaaccgcagcatcacaggcccggctcgcgtctttgaatctgaagaggagtgtctagacgcgattttggccaacaaaatcaaggcaggcgacgtgattgttgtgcgctacgaagggccaaaaggcgggccggggatgcgtgaaatgctcgctcctacttctgccattatcggtgctggactgggtgactctgtgggtctaatcaccgacggtcgcttctcgggcggtacctacggcatggtcgttggtcacgtggcgcctgaggccgctgtcggcggcactattggcctagtcaaagaaggcgattctatcaccatcgatgcggataagctgctgctgcaggtgaacgttgctgatgaagaactcgcgcagcgcaaaagtcaatggagcccaccgcagccccgttacgaccgaggcgtattagcgaagtacgcaaagttagtgtcctccagtagcaaaggcgcagtgaccgacaaagacctgttctag

SEQ ID NO: 543 - protein, 579 aa, Brevundimonas sp.
MTQDSTSEPNKPNARSAAVTHGPNRAAARSYLRAAGMQDADFDKPMIGIVNTWSTVTPCNMHLDRLAKDVRAGIVAAGGYPVDFNTIVVTDGISMGTAGMKASLISREVVADSIELAIEGHQLDGVVCIVGCDKTIPAAAMALARMDIPGLVYYGGTIMPGVIGSREVSVQEVFEAIGAHSAGTLDDAGLKAVESAVCPGAGACGGQFTANTMAMALSVMGISPMGANDVPAVDPGKAAQGERCGRLIVERVFAGDTARKYITRASLKNAAVAVSASGGSTNAVMHLTAIAAEAGVDFGVEDCHQACVEAPVICDLKPGGRFLASHLFAAGGTRLVTQRMAEAGKIVNTPTVSGRSLFAEAAEAEETPGQVVVTTFDAPVMERGSFAVIYGDVAPEGAVIKLTGHKVDRFEGPACVFDSEEDAFHAVQDGSVGEGDVIIIRYEGPKGGPGMREMLQVTAALKGRKIDNVALLTDGRFSGASYGFVAGHISPEAAVGGPIALIRDGDRITIDVTNRRIDVNVDLATRRAGFTPHVVRPARGVFAKYRASVASAAQGAVTIPNPPPAQVPASHKSAAAQDA

SEQ ID NO: 544 - DNA, 1740 bp, Brevundimonas sp.
atgacgcaagattctacctcagaacccaacaagcccaatgcgcgcagcgcggcggtgacgcatggtccgaaccgggccgccgcccgctcgtatctgcgcgccgccggcatgcaggacgccgacttcgacaagccgatgatcggcatcgtcaacacctggtcgacggtcacgccgtgcaacatgcacctggaccgcctggccaaggatgtgcgcgccggcatcgtcgcagcgggcggctatccggtcgatttcaacaccatcgtcgtcaccgacggcatctcgatgggcacggcgggcatgaaggcctcgctgatcagccgcgaggtcgtcgccgactccatcgaactggccatcgagggccatcaactggacggcgtggtctgcatcgtcggctgcgacaagaccattcccgcggcggccatggccctggcccggatggatatccccggcctggtctattacggcggcaccatcatgcccggcgtgatcgggtccagggaggtctcggtccaggaggtgttcgaggccatcggcgcccattcggccgggacgctggacgacgcggggctgaaggcggtcgagagcgcagtctgccccggcgccggcgcctgcggcggccagttcacggccaacaccatggccatggccctgtcggtcatgggcatctcgcccatgggcgccaatgacgtgccggcggtcgatccgggcaaggcggcccagggcgagcgctgcggtcgcctgatcgtcgagcgggtgttcgccggcgacaccgcccgcaaatacatcacccgcgccagtctgaagaacgccgccgtagccgtttccgcctcgggcggttcgaccaacgccgtcatgcacctgacggccatcgcggcggaggccggggtcgatttcggcgtcgaggactgccaccaggcctgtgtcgaggcgccggtcatctgcgacctgaagccgggcggccgcttcctggcctcgcacctgttcgccgccggcggcacccgtctggtcacgcagcgcatggccgaggccggcaagatcgtgaacaccccgaccgtcagcggccgcagcctgttcgccgaagccgcagaggccgaggagacccccggccaggtggtggtgacgaccttcgacgcgccggtcatggagcgcggcagcttcgccgtcatctatggcgacgtcgccccggaaggcgcggtcatcaagttgacgggccacaaggtcgacaggttcgaaggtccggcctgcgtcttcgacagcgaggaagacgccttccacgcggtccaggacggctcggtcggcgaaggcgacgtcatcatcatccgctacgaagggcccaagggcggtccgggcatgcgcgagatgctgcaggtcaccgccgctctgaagggccgcaagatcgacaatgtcgccctgctgaccgacggccgcttctcgggcgccagctacggcttcgtcgccggccacatctcaccggaagccgccgtgggcggcccgatcgctctcattcgcgatggtgaccgcatcaccatcgacgtcaccaaccgccgcatcgacgtcaacgtcgatctggcgacgcgccgggcgggctttacgccccacgtggtccgcccggcgcgaggtgtcttcgccaaataccgcgcctcggtcgcctcggcggcccagggcgcagtcaccattcccaacccgccgccggctcaagttccggcgtctcacaaatccgctgctgctcaggacgcctga

SEQ ID NO: 545 - protein, 561 aa, Dyadobacter fermentans
MATELNRFSKTLTQEVTNPAAQAMLYGIGLKEEDFVKPQIGIASTGYEGNPCNMHLNGLSVYVKQGVTANDMVGLIFNTIGVSDGMTNGNDGMRYSLPSRDIIADSIETVVAAQWYDGVIAVVGCDKNMPGAIMAMARLDRPAIMVYGGTIRSGHYKGQKLDIVSAFEALGKKFANNISDEDYKGVIQNSIPGQGACGGMYTANTMASSIEAMGLSLPFSSSYPATHEGKQEECKKIGAAMKKLLELNITPKDIITKKSLENALTVVMALGGSTNAALHYLAIARAAGIPLTLDDIQAISDRTPFIADLKPSGKYFMEDILEIGGVPAVTKYLYSVGLIHGDCITVTGKTVAENLAEAPDLNFETQKMVFPIETPIKKTGHIQVLYGNLAPQGAVAKITGKEGLTFDGEAKVCEHESEIIDMLAKGEIKAGHVVVIRNAGPKGGPGMSEMLKPTSAVMGAGLGDKIALITDGRFSGGTHGFVVGHITPEAFDGGPIALVKDGDRISIDANTRVLTLHISDEEMAARKAAWVQPAPRFTKGMLGRYIRTVKSASEGCVTDEA

SEQ ID NO: 546 - DNA, 1686 bp, Dyadobacter fermentans
atggcgacagaattaaacagattttcgaagacccttacccaggaagtaaccaatcccgccgcacaggccatgctttatggaattggtttgaaagaagaagactttgtgaaaccccagatcgggattgccagcacaggatatgaaggtaacccgtgcaacatgcacctgaacggcctttcggtgtatgtgaaacagggtgtgacagcgaatgatatggtgggtctgatcttcaacacgatcggcgtgtcggacgggatgaccaacggtaacgacggaatgcgctattcgctgccaagccgcgacattatcgctgattcgatcgaaacggtggtggctgcgcaatggtacgatggtgtgattgcggtggtgggttgtgataaaaacatgccgggagccattatggcgatggcgcgcctggaccgtccggcgattatggtgtatggcggaacgatccgctcggggcattataaaggacaaaagctcgacatcgtgtcggcatttgaagcgctgggcaagaagtttgccaacaatatttctgatgaagattataaaggtgtaattcaaaattcgatccccggccagggtgcctgcggcggtatgtatactgctaatacgatggcttcctcgatcgaagcaatgggattgagcctgccgttcagcagctcttacccggctacgcacgaaggcaagcaggaagaatgcaaaaaaatcggcgcggcaatgaagaaattgctcgaactgaacattacaccgaaagatattattaccaaaaaatcactggaaaacgcattgactgtcgtaatggcgctcggcggctctaccaacgcggcattgcactacctggcgatcgcacgcgcggcgggtattccattgactttggacgacattcaggctatttccgaccgcacgccgtttatcgccgatttgaaacctagcggtaaatacttcatggaggatatcctggaaatcggcggtgttcctgcggtaaccaagtatttgtattccgtaggtttgatccacggagattgcattacggtaacaggtaaaacagtggctgaaaaccttgccgaggctcctgacttgaattttgaaacacagaaaatggtgttcccgatcgaaacaccgatcaagaagaccggccacattcaggtgctttacggtaacctggctccccagggtgcggttgcgaaaatcaccggtaaggaaggtctgacgttcgacggcgaagcgaaagtgtgcgagcacgaatcggagatcatcgatatgctggccaaaggcgaaatcaaagccggccacgtggtggtgatccgcaatgcaggtccgaaaggtggtccgggcatgtcggaaatgctgaaaccaacctctgccgtaatgggtgcaggattgggcgacaagatcgcgttgatcaccgacggtcgtttctcgggcggcacgcacggcttcgtggtaggtcacatcaccccggaagcattcgacggcggccctatcgcattggtaaaagacggcgaccgcattagcatcgacgccaacacccgcgtactgaccctgcacatttccgacgaagaaatggcagcccgcaaagccgcctgggtacaacccgcgccacgctttacaaaaggaatgctgggaagatatatcagaaccgtgaagtcggccagcgaaggctgcgtgacggacgaagcgtaa

SEQ ID NO: 547 - protein, 561 aa, gamma proteobacterium
MALNRRSKNITEGVQRAPNRSMYYGMGYEAADFNKPMVGIANSHSTITPCNAGLQPLADAAQEGLREAGANPQIFGTPTISDGMSMGTEGMKYSLVSREVIADCIETCVGGQWMDGVLVIGGCDKNMPGGMMGMLRANVPSIFVYGGTILPGRHNGQDLNIVSVFEAVGEHAAGRIKDEDLLAIERNAIPGTGSCGGMYTANTMSSAFEALGMSLPYSSTMANVESEIKESAKQSALALVEAIRQDIKPRDIVTRESLENAVSVIMATGGSTNAVLHFLAIAHAAEIDWSIDDFERIRQRVPVICDLKPSGQYLAIDLHRAGGIPQVMKILLDGGLLHGDCMTVTGKTIAELLADVSATPAADQSVIRTLDNPMYAKGHLAILRGNLAEEGAVAKITGLKNPAITGPAKVFDDEQSALDAILANKVEAGDVVVLRYLGPKGGPGMPEMLAPTGALVGQGLGESVGLITDGRFSGGTWGMVVGHVAPEAYAGGLIGLVEEGDSITIDAHTLTLQLNVDDAEIARRRSHWTQPAPRYTRGVLAKFAKNAASASRGAVLDLYEE

SEQ ID NO: 548 - DNA, 1686 bp, gamma proteobacterium
atggcgcttaaccgtcgatccaaaaacatcaccgaaggcgtgcaacgtgcgcccaaccgctctatgtattacggcatgggttatgaggcggcggattttaataaacctatggtgggtattgccaattcgcattctacgattacgccctgtaatgctggcttgcagcccttggcggatgcggcccaggagggtcttagagaggccggagcgaacccacagatttttggtacgcccacgatttccgacggcatgtccatgggtaccgagggcatgaagtactcgctggtatccagagaggtgattgcggactgcatcgagacctgtgtgggtggccagtggatggatggcgtactggtgatcggcggttgtgacaagaatatgcctggcggcatgatgggtatgctccgcgccaatgttccatcgatttttgtctacggcgggaccattcttcctggtcgtcacaacggtcaggatctgaacattgtgagcgtgtttgaggcagtgggagagcatgcggccgggcgaatcaaagacgaggacctgttggccattgagcgcaatgcgataccgggtaccggatcctgcgggggtatgtacaccgctaacaccatgagctctgccttcgaagcgctgggcatgagtctgccgtattcctcgaccatggccaacgtggagtccgagatcaaagagtctgcaaaacaaagcgcattggccctggtagaggcgattcgtcaggacatcaagccccgggacattgttacccgggagtcccttgagaatgcggtttcggtaatcatggccacgggtggttctaccaacgccgtgctgcacttcctggcgattgcccacgcggcagagatcgactggagcattgatgactttgaacgtattcgccagcgcgtgccggtgatatgcgaccttaagcccagcggccaataccttgccatcgatttgcatcgtgcggggggaattccgcaggtcatgaagattctcctggacggcggcctgctccacggcgattgcatgaccgtgacgggcaagaccattgcggagttactggctgatgtgtccgccacgccggcagcggatcagtcggtgattcgtacgctggataatcccatgtacgccaagggtcatctggcaattctgcgcggcaacctggcagaagagggcgctgtggccaaaatcacgggcctgaagaatcccgctatcaccgggccggccaaggtctttgatgacgagcagtctgccctggatgctattttggccaacaaagtagaagccggtgatgtggttgttctgcgttacctgggtcccaagggcggaccgggtatgccggagatgctggcgcccacgggtgcgctggtgggccaggggctgggggagtccgtagggcttatcaccgacgggcgtttttccgggggcacctggggcatggtggtcgggcatgtagcaccggaagcctatgccggcggcttgattggtctggtagaagagggagactccatcactattgatgcgcataccctgacgctccaactcaacgttgatgatgcagaaatcgcacggcgccgcagtcattggactcagccagcgcctcgttacacacgcggcgtgctcgccaagttcgcaaagaacgcagccagtgcgagtcgcggtgctgttcttgatctttatgaagagtaa

SEQ ID NO: 549 - protein, 561 aa, gamma proteobacterium
MASNRRSKNITEGVQRAPNRSMYYGMGYKAEDFKKPMVGIANAHSTITPCNAGLQVLADAAEIGLKEAGANPQIFGTPTISDGMSMGTEGMKYSLVSREVIADCIETCVGGQWMDGVLVIGGCDKNMPGGMMGMLRANVPSIFVYGGTILPGRLNGEDLNIVSVFEAVGEHAAGRIKDEDLLAIERNAIPGTGSCGGMYTANTMSSAFEALGLSLPYSSTMANVEDEIKDYAQQAATALVEAVRLDLKPRDIMTREALENAVAVIMATGGSTNAVLHFLAIAHAGEIEWNIDDFERVRRKIPVICDLKPSGKYLAIDLHRAGGIPQVMKILLEAGLLHGDCMTITGKTVAENLADIPATPPADQSVIRPIEKPMYAEGHLAILRGNLAEEGAVAKITGLKNPQITGPARVFDDEQSALEAILAGQIKAGDVVVLRYLGPKGGPGMPEMLAPTGALVGQGLGESVGLITDGRFSGGTWGMVVGHVAPEAYAGGLIALVEDGDTITIDAHQLLLNLEVPKAEIERRRANWVKPPPRYTRGVLAKFARNAASAAYGAVLDGEGS

SEQ ID NO: 550 - DNA, 1686 bp, gamma proteobacterium
atggccagcaaccggcgctcaaaaaatattaccgagggtgttcaacgcgcccccaatcgctccatgtactacggcatgggttacaaggcagaggatttcaagaagcccatggtgggtatcgccaatgcccactcgaccatcacgccgtgtaatgccggtttgcaagtgttggctgacgcggctgagatcgggcttaaggaggcgggtgcaaatccacagatctttggtaccccaaccatctccgatggcatgtccatgggcaccgaggggatgaagtactcgctggtctcccgtgaggtcatcgccgactgtatcgagacctgcgtcggcggccagtggatggatggcgtactcgttatcggtggctgcgacaagaatatgcccggtggcatgatgggcatgctgcgtgccaacgtgccgtcgatctttgtttacggcggcaccattctgcccgggcgtctcaacggcgaggacctcaatatcgtcagcgtcttcgaggccgttggcgagcatgcggcggggcgcatcaaggatgaagatctgctcgccatcgagcgcaatgcgatcccgggtacagggtcctgcggcggaatgtataccgccaataccatgagttcggcctttgaagcgctcggcttaagcctgccttactcctccaccatggccaatgtcgaggacgagatcaaagactacgcccagcaggcggcgacggcgctggttgaggcggtacgactcgatctgaagccgcgggatatcatgacccgcgaggcgctggaaaacgccgtggccgtgattatggccaccggcgggtccaccaacgcagtgctgcattttctggcgatcgcccacgccggcgaaatcgagtggaacatcgatgattttgagcgtgtgcggcgcaagattccggtgatctgtgatctgaagcccagtgggaaatacctggcgatcgacctgcatcgcgccggtggcattccccaggtcatgaagattttgctcgaggccgggctactgcacggcgactgtatgacgatcaccggtaaaaccgtggcggaaaatctcgccgatattcctgcaacaccaccggcggatcagagtgtgatccgccccatcgaaaagcccatgtatgccgaaggtcacctggcgattttgcgtggaaatcttgcggaagagggcgctgttgccaagatcaccgggctcaagaatcctcagatcaccggtcccgcgcgggtgtttgacgacgagcagtcggcgctcgaagctattcttgcggggcagattaaagccggcgatgtggtggtattgcgctacctcggcccgaagggcggtccgggcatgcccgagatgctggcacccacgggtgcgctggtagggcagggtctgggtgagtcggtagggttgattaccgatggccgtttttccggcggcacctggggcatggttgttgggcacgtggcgccagaggcctacgcgggcggcttgatcgcgctggttgaagatggcgatacgatcactatcgatgcccaccagctgctgctgaacctcgaggtgccgaaggcggagattgagcggcgccgggccaactgggttaagccgccaccgcgttacacccgcggggtgctcgcgaaatttgcccgcaacgcggcgagcgccgcctacggtgccgtgcttgatggcgaggggtcctga

SEQ ID NO: 551 - protein, 556 aa, Cyanobium sp.
MLRSDAITQGVQRSPNRAMLRAVGFGDDDFGKPIIGIANGYSTITPCNLGLNDLTRRAEQAAQAAGAMPQTFGTITVSDGISMGTEGMKYSLVSREVIADSIETACNAQSMDGLLAVGGCDKNMPGAMLAMARMNIPAIFVYGGTIKPGRLGPCDLTVVSAFEAVGQFSGGRIDESELLAIEKNACPGAGSCGGMFTANTMSSAFEVLGLSLPYSSTMAAEDPEKAESAARSAEVLVQAIAADIRPRDLLTREAFENAISVIMAVGGSTNSVLHLLAIARTAGVELSIDDFERIRQRVPVICDLKPSGRYVTVDLHRAGGIPQVMKLLLDAGLLHGDCRTIEGKTLTEVLASVPSDPPADQDVIRPLSNPLYARGHLAILKGNLAEEGAVAKISGVKTPVITGPARVFESEESCLAAILAGGIQPGDVVVVRNEGPVGGPGMREMLSPTAAIIGQGLGESVALITDGRFSGGSYGLVVGHVAPEAAVGGTIGLVHEGDSITVDANQLLIQLNVPDEELAARRAAWVKPEPRYRTGVLGKYARLVSSSSLGAVTDLA

SEQ ID NO: 552 - DNA, 1671 bp, Cyanobium sp.
atgctccgttccgatgcgatcacccagggcgtccagcgctcgcccaaccgggccatgctgcgggccgtgggtttcggggatgacgacttcggcaagccgatcatcgggatcgccaacggctacagcacgatcacgccctgcaacctcggcctgaacgacctcacccgccgggcggagcaggccgcccaggccgccggggccatgccccagaccttcggcaccatcacggtgagcgatggcatctcgatgggcaccgaagggatgaagtactccctggtgagccgcgaggtgatcgccgattcgatcgaaaccgcctgcaacgcccagagcatggacggcctgctggctgtgggcggctgcgacaagaacatgcccggcgccatgctggccatggcccggatgaacatcccggctatcttcgtgtacgggggcaccatcaagcccggcaggctggggccctgtgacctcacggtggtgagcgccttcgaggcggtcggccagttctccggcggtcgcatcgatgagtccgaactcctcgcgatcgagaagaacgcctgtcctggtgccggcagctgcgggggcatgttcaccgccaacacgatgagttcggccttcgaggtgctgggcctcagccttccctacagctccaccatggcggcggaagatccggagaaggcggagagcgccgcccgttccgccgaggtgctggtgcaggccatcgccgccgacatccgtccccgggacctgctcacccgggaggccttcgagaacgccatcagcgtgatcatggccgtgggcggttccaccaactcggtgctgcacctgctggccatcgcccgcaccgcaggggtggagctcagcatcgacgacttcgagcggatccgccagcgcgtgccggtgatctgcgacctcaagcccagcggccgctatgtgacggtggacctgcatcgggccgggggcattccccaggtgatgaagctcctgctcgacgccggtctgctgcatggcgactgccgcacgatcgaaggtaagaccctcacggaggtgctggcttcggttcccagtgatccccccgccgatcaggacgtgatccgtccgctcagcaaccccctctatgccagggggcacctggccatcctcaagggaaatctggcggaggaaggggcggtggccaagatctccggggtgaagaccccggtgatcaccggcccggcccgggtgttcgagagcgaggagtcctgcctggccgccattctggccggcggcatccagcccggcgacgtggtggtggtgcgcaacgaggggccggtgggcgggcccggcatgcgcgagatgctgagccccacggccgccatcatcggccaggggctgggcgagagcgtcgccctgatcaccgacggtcgcttctccggtggctcctacggcctggtggtgggccatgtggccccggaggccgccgtggggggaacgatcggcctggtgcacgagggggacagcatcaccgtggatgcgaaccagctgctgatccagctgaacgtgcccgacgaggaactggctgcccggcgggctgcctgggtgaagcccgagccccgctaccgaaccggtgtgctcggcaagtacgcccggctggtgagcagcagcagcctcggtgcggtgaccgatctggcctga

SEQ ID NO: 553 - protein, 540 aa, Jonesia denitrificans
MLRAVGLGDDDFAKPQIGVASSWNEITPCNLSLDRLAGAVKEGVHAAGGFPLEFGTISVSDGISMGHEGMHYSLVSRDVIADSVEVVMEAERLDGSVLLAGCDKSLPGMLMAAARLNVSSVFLYAGSIMPGWVKLSDGTEKDVTLIDAFEAVGACVRGLMSREDVDRIERAICPGEGACGGMYTANTMAAVAEALGMSIPGSAAPPSADRRRDMFARRSGQAVVDLLNAGITARDIMTKPAFENAIAVVMALGGSTNAVLHLLAIAHEAEVDLSLDDFAAVARRVPHLADVKPFGRYVMNDVDRIGGIPVVMKALADAGLLDGDCLTVTGRTVAENLADIAPPDPDGVILRVMDQPIHPTGGITILHGSLAPEGAVVKSAGFDRSVFTGTARVFEGERAAMDALEDGTIRAGDAVVIRYEGPKGGPGMREMLAVTGAIKGAGLGRDVLLLTDGRFSGGTTGLCVGHIAPEAVDGGPIALVRDGDTIRLDVDAGTLDVLVDEGEMAARAVDWVPASRPVKRGVLAKYAQLVGSASRGAVLG

SEQ ID NO: 554 - DNA, 1623 bp, Jonesia denitrificans
atgttgcgcgcagtcgggttgggcgatgatgattttgccaaaccccaaattggggtggcatcgtcgtggaacgaaataaccccgtgcaacttgtcgttggatcgtcttgcgggggcggtgaaagagggtgtgcacgccgcaggtgggttcccgttggagtttggcacaatttcggtgtcggatggtatctccatgggacatgaggggatgcactattcgttggtttcccgtgatgtcattgctgattctgtggaagttgtcatggaagcggaacgactcgacggttccgtacttctagccggttgtgataagtcgttgccggggatgctgatggcggctgcgcgtctcaatgtctcgagtgtgttcttgtatgccggatcgatcatgccggggtgggtcaaacttagcgatggaacggaaaaagacgtcaccctcattgacgcgtttgaggcagtaggggcgtgtgtgcgcgggctgatgtcacgtgaggatgtggatcgcatcgaacgtgctatttgccctggtgagggtgcatgcggtgggatgtataccgcaaatacgatggctgctgtggccgaggcattgggaatgtcgatcccgggttctgcggcgcctccgagtgcggatcgccgtcgggatatgtttgctcgtcgaagcggtcaggcggtggtcgacttgctcaatgcggggataaccgcacgtgacattatgacgaagcctgcgtttgagaatgctattgctgtggtgatggctctgggtgggtcaacgaatgcggtgttgcatttgttggcgattgctcacgaagctgaggttgatttgtcgttggatgattttgcggcggttgctcgccgcgttccgcacctcgcggatgtgaaaccgtttggtcgttacgtgatgaatgatgtggatcgcatcggtggtatcccggttgtcatgaaggcgcttgctgatgcggggctgcttgatggggattgtctgacagtgacagggcgaacggtggcggagaacctcgccgatattgctcctccggaccctgacggggtcattcttcgggtgatggatcagccgattcatcccacgggagggatcacgattttgcatgggtcgttggcgcctgagggggcggtggtgaagtctgctggttttgaccggtcggtgttcacggggaccgcccgggtgtttgagggggaacgtgccgccatggatgcgttggaggatgggactattcgggctggggacgcggtggtgatccgttatgaggggccgaagggtggccctgggatgcgagagatgcttgcggtgactggcgcgattaagggggctgggctggggcgagatgtgctgttgttgactgatgggcgtttttccggtgggacaacgggactgtgcgtggggcatattgctccggaggctgtggatggtggccctattgcgttggtgcgtgatggggacacgatccggttggacgtggacgcgggcactctcgatgtgcttgttgatgagggggagatggcggcccgggctgttgattgggttccggcatcgaggccggtcaagcgcggcgtgttggcgaagtacgcacaacttgttgggagtgcgtctcgaggtgcggtccttgggtga

SEQ ID NO: 555 - protein, 579 aa, Brachybacterium faecium
MDADDETTAPATTRDSAPDIKPRSRQVTDGLGATVSRGMLRAVGMGDADWDKPQIGIASSWNEITPCNLSLDRLAQAAKEGVHSGGGYPLQFGTISVSDGISMGHDGMHYSLVSRDLIADSVETVMSAERLDGSVLLAGCDKSLPGMLMAAARLDLASVFVYAGTIMPGRVSLSTGEEKDVTIIDGFEAVGACARGLMSREDVGRIERSICPGEGACGGYYTANTMSTVAEAIGMSIPGSATPPSADRRRDADARRAGEAVVGMLRQGITSHDIMSKAAFENAIAVVQAFGGSTNAVLHLLAIAHEAEVDLTLDDFARIGAKVPHLADLKPYGRYVMNDVDHVGGIQVVMKTLLDEGLLDGDCLTVTGRTIAENLEVLQPRPADGTVLRPASAPIAPTGGITILHGSLAPEGAVVKSAGFEEDVFEGTARVFEREQHALDALNDGTIDHGDVVVIRYEGPKGGPGMREMLAITGAIKGAGLGKDVLLMTDGRFSGGTTGLCVGHIAPEAVDGGPIAVVRDGDRIRLDVSTGALDLLVDEEELAARWEGWEPLPPKFTKGVLGKYVQLVKSASRGAILGE

SEQ ID NO: 556 - DNA, 1740 bp, Brachybacterium faecium
atggacgccgacgacgagaccactgcccctgccaccactcgggattccgcccccgacatcaaaccgcgcagccgccaggtcaccgacggcctgggcgcgacggtctcgcgcggcatgctgcgcgcggtgggcatgggtgacgctgactgggacaagccgcagatcggcatcgccagctcctggaacgagatcaccccctgcaacctgtcgctggaccgcctcgcgcaggcggcgaaggagggggtgcattccggcggcggctacccgctgcagttcggcaccatctccgtctccgacggcatctccatggggcacgacggcatgcactactcgctcgtctcccgcgacctgatcgccgacagcgtcgagacggtgatgagcgccgagcggctcgacggctcggtgctgctggccggctgcgacaagtccctgcccggcatgctgatggccgcggcccgtctggacctggccagcgtgttcgtctatgcgggcacgatcatgccgggccgggtctccctctccaccggagaggagaaggacgtgacgatcatcgacggcttcgaggccgtcggcgcctgcgcgcgcgggctgatgagccgggaggacgtcggccgcatcgagcgctcgatctgcccgggcgagggcgcctgcggcggctactacacggccaacaccatgtcgacggtcgccgaggccatcggcatgtcgatccccggctccgccactcccccctcggccgatcgccgccgcgacgcggacgcacggcgcgcgggcgaggccgtggtcggcatgctccgccagggcatcaccagccacgacatcatgagcaaggccgccttcgagaacgcgatcgcggtggtccaggccttcggcggctcgaccaacgcggtgctgcacctgctcgcgatcgcgcacgaggcggaggtggacctcaccctggacgacttcgcccggatcggcgcgaaggtcccccacctcgccgatctcaagccctacggccgttacgtgatgaacgacgtcgaccacgtgggcggcatccaggtggtgatgaagacgctgctggacgagggcctgctggacggggactgcctgacggtcaccgggcgcacgatcgccgagaacctcgaggtgctgcagccgcggccggccgacggcacggtgctgcgcccggcctcggcgccgatcgcccccaccggcggcatcacgatcctgcacggctccctggcgcccgagggcgcggtggtgaagtccgccggcttcgaggaggacgtcttcgagggcacggcgcgcgtgttcgagcgcgagcagcacgccctggatgccctgaacgacggcaccatcgaccacggcgacgtggtggtgatccgctacgagggccccaagggcgggcccggcatgcgcgagatgctcgcgatcaccggcgcgatcaagggcgcgggcctgggcaaggacgtgctgctgatgaccgacggacgcttctccggcggcaccaccgggctgtgcgtcgggcacatcgcgcccgaggccgtggacggcggcccgatcgccgtcgtgcgggacggggaccggatccgcctggacgtgagcaccggggcgctcgacctgctcgtggatgaggaggagctggccgcccgctgggagggctgggagccgctgccgccgaagttcaccaagggcgtgctgggcaagtacgtgcagctggtgaagtccgcgtcccgcggagcgatcctcggggagtga

SEQ ID NO: 557 - protein, 561 aa, Paenibacillus sp.
MANGKDLRIRSKVISEGVNRVPNRAMLRAVGFTDEDFKKPMIGVASTWSEVTPCNMHINDLAAQAKLGVRNHGGAPLIFNTITVSDGISMGHGGMLFSLPSREAIADSIEIVTGAERFDGIVAIGGCDKNTPACLMAIGRMNLPAVYVYGGTIQPGNLDGKKVDIVTAFEAVGQYHDGRMTDEQLHKVECSVCPGPGSCGGMYTANTMAAAAEAMGMCLPGSSSTPAISPDKAAECAAAGKQVISLLEQEIYPKDIMTRKAFENAITVVMALGGSTNAFLHLLAIAHSVGVDLTLDDFEQIRLRVPHLADLKPSGRYAMQDLNDIGGVPGVMKLLLAEGLLHGDCLTVTGKTLAENLADIAPLQQDQDVIRPFDNPLKPNGPLVVLKGNLAPEGAVAKMSGMKKLRFVGPAKVYDSEEDATEAILRNEIRKGDVLVIRYCGPKGGPGMPEMLSVTALIVGKGLGGEVALLTDGRFSGGSHGFVVGHVSPEAQVGGPIAVLRNWDIVTIDSETQEIMFQVTDEELAARTQAWVQPPLKVSSGVLVKYARLVSSASKGAVTDL

SEQ ID NO: 558 - DNA, 1686 bp, Paenibacillus sp.
atggcaaatggaaaagatcttcgaatccgcagcaaggtaattagcgagggagtcaatcgggtgccaaacagggcgatgctgcgcgccgtaggttttactgacgaggatttcaagaagccgatgattggcgtagccagtacctggagtgaagtcactccgtgcaatatgcatatcaacgacttggccgctcaggctaagcttggagttcgcaatcacggcggcgcacctctgatttttaatacgattacggtttcagacggtatatccatgggacatggaggcatgttgttctccctgccgagcagggaagcaattgcagattccattgaaattgtaaccggcgccgaacggtttgacggtatagtggcaattggcggttgcgacaaaaacactccagcctgtctgatggcaatcggtcgaatgaatctcccggccgtttacgtgtatggaggaaccattcaacccggtaatttggacgggaagaaagtcgatatcgttacggcttttgaagcggttggccaatatcatgacggaaggatgacagacgagcagcttcacaaggtcgaatgcagcgtatgtccgggtccaggctcttgcggcgggatgtataccgctaatacgatggctgcagcggcggaagcaatgggcatgtgtctcccgggctcttcatccacgccagctatttctccagacaaagctgcggaatgcgcggcagccggtaaacaggttatttcgctgctggaacaggagatttatccgaaagacattatgacaaggaaagcgttcgagaatgcgattacggtcgttatggcgttgggaggctcaaccaatgcattcttgcatctgctcgccattgcgcactcggtaggcgttgatctaactttggatgattttgagcagattagacttcgcgtacctcatctggcagacctgaagccaagcggccgatatgccatgcaggatttaaacgatattggcggagttccgggcgtcatgaagttattgcttgctgaaggccttcttcacggggattgcctaaccgttaccggtaagactctggcggaaaatttagccgacatagctcctctgcaacaggaccaggacgttattcgtccatttgacaatccgctgaagccaaacgggccactggtagtccttaaaggaaatctggctccggaaggggccgttgccaagatgtcaggcatgaaaaaactgaggtttgtcggaccggcaaaagtgtacgacagcgaggaggacgcaaccgaagccatcttgaggaatgagatccgcaaaggagacgtattggtgattcgatactgcggacctaagggtggaccaggcatgccggagatgttatccgttaccgcattgattgtaggcaaagggcttggcggggaagttgctctgctcacggatggacgattctctggcggctcgcacggatttgtagttggccatgtttctccggaagctcaagtaggtggaccaattgcggtgcttaggaattgggacatcgtaacgattgacagcgaaacccaagagatcatgttccaagtgacagatgaggaattggccgcccggacgcaagcatgggtacagccaccgctcaaagtaagctcaggcgtattagtaaagtatgcccgactggtgtcctcagcttctaaaggagcggttactgatctttaa

SEQ ID NO: 559 - protein, 577 aa, Octadecabacter antarcticus
MTRKATDKTNLPSRHVTEGPSRAPHRSYFYAMDLTEEQINQPFVGVATCWNEAAPCNISLNWQARSVKRGVKEASGTPREFTTITVTDGLAMGHEGMRSSLASRDAIADTVELTMRGHCYDAIVGLAGCDKSLPGMMMAMVRLNTPSVFMYGGSILPGRHEGKDITVQDMFEAVGKYQAGQMTDAELAVMERVACPSAGACGGQFTANTMACVSEAIGLALLNSSGMPAPYEDRAQYGEASGQAVMNLIAKNIRARDVVTRKSLENAARVVACTGGSTNAGLHLPAIAHEAGIDFNLFDVCDIFRDTPYFVDLKPGGQYVAKDMFEVGGVPVVMKELRKAGLWHDDCMTASGKVIGEELDMIKGEADGKVIYPVENPITKTGGVVGLKGNLAPDGAIVKVAGMSDDEQVFTGPARVFESEEDAFSAVKARCYKEGEVLVIRNEGPSGGPGMREMLATTAALSGQGMGKKVALITDGRFSGATRGFCVGHVGPEAAHGGPIGMLKDGDMITMNAVSGELSVDLTDAELAQRKADWVGPKETIYASGALWKYAQLVGGALNGAVTHPGAKHERHIYMDL

SEQ ID NO: 560 - DNA, 1734 bp, Octadecabacter antarcticus
atgacccgcaaagcaaccgacaagacgaacctgcccagccgccatgtcacagaaggcccgtcgcgcgcgccgcatcggtcgtatttctacgcgatggacctgaccgaagagcagattaatcaaccatttgtcggcgtggccacctgctggaacgaagcagcgccttgtaacatttcactgaactggcaggcccgatcggtcaaacgtggtgtcaaagaagcaagcggtacgccgcgcgaatttaccaccatcaccgtcaccgatggccttgcgatgggccacgagggcatgcggtcgtcgttggcatcgcgcgatgcgattgcggacacggttgaattgacgatgcgcggccattgctatgatgcgattgtcggtctggcgggctgcgacaaatccctgccggggatgatgatggccatggtgcgtctgaacacgccgagtgttttcatgtatggtgggtcgatcctgccgggtcgccacgaaggcaaagacattaccgttcaggatatgtttgaggctgttggcaaataccaagcgggtcaaatgacagacgctgaattggctgtgatggaacgggttgcatgcccgtctgcgggtgcctgcggtggtcagtttacggccaacacgatggcttgcgtttctgaggcgatcggcctcgcgcttttgaattcatccggcatgcccgcgccctatgaagaccgggcgcaatacggtgaggcgtcgggccaagcggttatgaacctgatcgcaaagaacatccgcgcccgcgatgtggtgacgcgcaagtcgctggaaaatgcggcacgtgtcgtcgcctgtacaggtgggtcgaccaatgctggcctacacctgcctgcaattgcacatgaagcgggcatcgatttcaacctgttcgacgtttgtgacattttcagagacacgccgtattttgtcgatcttaagccgggtggtcagtacgtggcaaaagacatgtttgaggtcggcggtgtgcctgtcgtgatgaaagaattgcgcaaagcgggcctgtggcatgacgattgcatgacggccagtggcaaagtcatcggcgaagaattggacatgattaagggtgaggctgatggcaaagttatttaccccgttgagaacccgatcaccaaaactggcggtgttgttggattgaagggtaatcttgcccctgatggtgccatcgtgaaggtcgctggcatgtctgacgacgaacaggtctttaccggtcctgcgcgggtgttcgaatcagaagaggacgctttttcggctgtgaaggcgcgctgctataaagaaggtgaagtgctggttatccgcaacgaagggccgtccggtggcccgggaatgcgtgaaatgctggcgacaacggcggcgctgtccggtcagggcatgggcaagaaggtcgcgctgatcactgatggtcgttttagtggcgcaacgcggggcttttgcgttggccacgtcgggcctgaggccgcacatggtggcccgattggtatgctgaaagacggtgacatgatcacgatgaacgcggtgagcggggaactatcggtcgatctgacagatgcagaactggcgcaacgcaaggcggattgggttggcccgaaagagacgatttatgcgtcgggcgcgctgtggaagtacgcgcaactggttggtggcgcgctgaatggcgcagtcacgcaccctggcgcgaaacatgaacgccacatctatatggatctgtaa

SEQ ID NO: 561 - protein, 564 aa, Variovorax paradoxus
MTTPTDPNSKRFRSATIREGTIRATTRSFLHALGQDDEDIARPHIGVFHTGGEMSPCNLNLREQAQHAKIGIYAGGGTPHECPVVSVSDGLTMAHSGMRFSLISRELIADSVEASTRGHQWDGIFAIGACDKNLPGLMMGMVRCNVPSVFVHGGSALPGQMPGPDGRDLNVVDTYETIGKVLAGTATHDELDAMSRACLPTAGACAGQFTANTMGMVSEALGLAPMGSSMVPAVFSERAPLMRRAAKNLMKAVMGDSPLPRDIVTRKALENACAVVSATGGSTNAALHLPAIAHEAGIKFHLDDVAEVFARTPLIADLRPGGQYLARDVFYIGGAGVILRTLMEQGFVHGDALSFTGRTLAEELADAAAPDGRVVRAPGNPITRDGGLAVLKGNLCPDGALLKTAGLQTLVHRGPARVFDSEEQAQAAVQNRRYEAGDVIVIRNEGPKGSPGMREMLGITALLYGQGMGDKVALLTDGRFSGATRGLCIGYAGPEAADGGPIAALQDGDMVAIDARPGARTISVELAAEEIALRLSRRQVNAGVAHRGLLENTRSPCAPPTRAP

SEQ ID NO: 562 - DNA, 1695 bp, Variovorax paradoxus
atgaccactcccaccgatccgaacagcaagcgctttcgctccgccaccatccgcgagggcacgatccgcgccaccacgcgcagcttcctgcatgcgctcggccaggacgacgaggacatcgcgcgcccgcacatcggcgtgttccacaccggcggcgagatgagcccgtgcaacctcaacctgcgcgagcaggcgcagcatgccaagatcggcatctacgcgggcggcggcacgccgcacgaatgcccggtggtgtcggtgagcgacgggctcaccatggcgcattcgggcatgcgcttctcgctgatctcgcgcgagctgatcgccgacagcgtggaggcctcgacgcgcggccaccagtgggacggcatcttcgccatcggcgcctgcgacaagaacctgccgggcctgatgatgggcatggtgcgctgcaacgtgccgagcgtgttcgtgcatggcggctcggctttgcccgggcagatgccgggccccgatggccgcgacctcaacgtggtcgacacctacgagaccatcggcaaggtgctggccggcaccgccacgcacgacgagctcgacgccatgagccgcgcctgcctgcccaccgcgggcgcctgcgcgggccagttcacggccaacaccatgggcatggtgtcggaggcgctgggcctggcgcccatgggctcgagcatggtgccggcggtgttcagcgaacgcgcgccgctgatgcgccgcgccgcgaagaacctcatgaaggcggtgatgggcgacagccccctgccgcgcgacatcgtcacgcgcaaggcgctcgagaacgcctgcgccgtggtctcggccaccggcggctcgaccaacgccgcgctgcacctgccggccatcgcgcacgaggccggcatcaagttccacctggacgacgtggccgaggtctttgcgcgcacgccgctcatcgccgacctgcgcccgggcgggcagtacctggcgcgcgacgtgttctacatcggcggcgcgggcgtcatcctgcgcacgctgatggagcagggcttcgtgcacggcgatgcactcagcttcaccggccgcacgctggccgaggaactggccgatgccgcggcgcccgacggccgcgtggtgcgcgcgcccggcaacccgatcacgcgcgacggcgggctggccgtgctcaagggcaacctctgccctgacggcgcgctgctcaagaccgcgggcctccagacgctggtgcaccgcggcccggcgcgcgtcttcgattcggaggaacaagcgcaggccgccgtgcagaaccgccgctacgaagccggcgacgtgatcgtgatccgcaacgagggccccaagggcagccccggcatgcgcgagatgctgggcatcaccgccctgctctacggccagggcatgggcgacaaggtggcgctgctgaccgacgggcgcttctcgggcgccacgcgcggcctgtgcatcggctatgcggggcccgaagcggccgacggcgggccgattgcggcgctgcaggacggcgacatggtggccatcgacgcgcggcccggggcgcgcaccatttcggtggaactggcagcggaagaaatcgcgctgcggctgtccagacgtcaggtaaacgcgggggtggcgcaccgcggcttgctggaaaatacgcgctcaccgtgcgccccgcccaccagggcgccgtga

SEQ ID NO: 563 - DNA, 1797 bp, Schizosaccharomyces pombe
atgatgttctgcaagcttctccgttgtcaaaacggtattgctagcaaaagagctgcattaagcctaaaaggctttaaaacctcttcgatcaatttagtcgagaagaaattgaacaagtatagtgaaacaatcactggtccgaagtctcagggtgcttcccaagctatgttatatgctactggacttaatgaggaggacatgaaaaaaccccaagtcggcattgctagttgttggtatgaaggaaatccttgcaatatgcatttacttgatctcggtcgacgagtgaaagaaggtgtcaaaaaggctggattgaccggattccagtttaatactattggtgttagtgatggtatttctatgggtactactggtatgcgttatagtttgcaatctcgtgagattattgcagactccattgagaccgtcatgcaaggtcaatggtatgatgccaacgtctctattcctggctgtgacaaaaacatgcctggttgtttaatcgctatgggaagattcaaccgccctagtattatggtttacggcggtagtattcgtgctggtcactctccttgtcagaacaatgcacccatcgatattgtttctgcttttcaatcctatggtgaatttatcacaggaaaaattgatgagccaacccgtcatgacattattcgtcatgcatgtcctggaggtggtgcttgtggtggtatgtatactgcaaatacaatggctagctgtgccgaagctatgggtatgacattacccggttcttcttcttaccttgctggctcacctgagaagtttgcagaatgcgaagctgcaggtagtgctataaagcgacttttggttgacgacattaaacctcgcgacatcatgacacgttctgcttttgaaaatgctatggtcttgacgatgactcttggtggctctaccaactctgttcttcatttgatcgcaattgctaagtctgttggtatcactttaactttggatgatttccaagccgtcagtaaccgtacaccgtttattgccgatatgaagcctagcgggaagtacgttatggaagatttgttcgctatcggaggtattccttcagtacttaaatatctccatgctgaaggtctcatcgatggttctaatattaccgttactggtaaaactctcgctgagaacctacgaggattcaaggaccttgccgaaggtcaaaagatcattagacctttgagcaaccccatcaagaccgagggtcatttacgtgtcctccgtggttctttagcccctgaaggttctgtcgcaaagattactggcaaagagggcttgaacttcaccggcaaagctcgtgtttttgatgccgaaaacgattttattgctgccttagagcgtggtgagttcaagaagggcgagaagactgtcgtcattattcgttttgagggaccaaaaggtggacctggtatgccggaaatgttaaagccttcaagtgctattatgggagctggtcttggaaaggatgttgcacttttgactgacggtcgtttcagtggtggctctcacggatttttgattggacacgttgatcccgaagcacaagttggaggccctattgctcttgttcaggacggcgatgtcattgaaatcaatgctgtaaagaacactttagatttgatggttgatgagaaggagatggcgagacgccgcagtgtttggaaggcacctcctttgaagtaccaacaaggaacccttttaaaatatgctcgcaacgttagcactgcctccaagggtgctgttacagattccttagagtaa

SEQ ID NO: 564 - protein, 598 aa, Schizosaccharomyces pombe
MMFCKLLRCQNGIASKRAALSLKGFKTSSINLVEKKLNKYSETITGPKSQGASQAMLYATGLNEEDMKKPQVGIASCWYEGNPCNMHLLDLGRRVKEGVKKAGLTGFQFNTIGVSDGISMGTTGMRYSLQSREIIADSIETVMQGQWYDANVSIPGCDKNMPGCLIAMGRFNRPSIMVYGGSIRAGHSPCQNNAPIDIVSAFQSYGEFITGKIDEPTRHDIIRHACPGGGACGGMYTANTMASCAEAMGMTLPGSSSYLAGSPEKFAECEAAGSAIKRLLVDDIKPRDIMTRSAFENAMVLTMTLGGSTNSVLHLIAIAKSVGITLTLDDFQAVSNRTPFIADMKPSGKYVMEDLFAIGGIPSVLKYLHAEGLIDGSNITVTGKTLAENLRGFKDLAEGQKIIRPLSNPIKTEGHLRVLRGSLAPEGSVAKITGKEGLNFTGKARVFDAENDFIAALERGEFKKGEKTVVIIRFEGPKGGPGMPEMLKPSSAIMGAGLGKDVALLTDGRFSGGSHGFLIGHVDPEAQVGGPIALVQDGDVIEINAVKNTLDLMVDEKEMARRRSVWKAPPLKYQQGTLLKYARNVSTASKGAVTDSLE

SEQ ID NO: 565 - DNA, 1758 bp, Saccharomyces cerevisiae
atgggcttgttaacgaaagttgctacatctagacaattctctacaacgagatgcgttgcaaagaagctcaacaagtactcgtatatcatcactgaacctaagggccaaggtgcgtcccaggccatgctttatgccaccggtttcaagaaggaagatttcaagaagcctcaagtcggggttggttcctgttggtggtccggtaacccatgtaacatgcatctattggacttgaataacagatgttctcaatccattgaaaaagcgggtttgaaagctatgcagttcaacaccatcggtgtttcagacggtatctctatgggtactaaaggtatgagatactcgttacaaagtagagaaatcattgcagactcctttgaaaccatcatgatggcacaacactacgatgctaacatcgccatcccatcatgtgacaaaaacatgcccggtgtcatgatggccatgggtagacataacagaccttccatcatggtatatggtggtactatcttgcccggtcatccaacatgtggttcttcgaagatctctaaaaacatcgatatcgtctctgcgttccaatcctacggtgaatatatttccaagcaattcactgaagaagaaagagaagatgttgtggaacatgcatgcccaggtcctggttcttgtggtggtatgtatactgccaacacaatggcttctgccgctgaagtgctaggtttgaccattccaaactcctcttccttcccagccgtttccaaggagaagttagctgagtgtgacaacattggtgaatacatcaagaagacaatggaattgggtattttacctcgtgatatcctcacaaaagaggcttttgaaaacgccattacttatgtcgttgcaaccggtgggtccactaatgctgttttgcatttggtggctgttgctcactctgcgggtgtcaagttgtcaccagatgatttccaaagaatcagtgatactacaccattgatcggtgacttcaaaccttctggtaaatacgtcatggccgatttgattaacgttggtggtacccaatctgtgattaagtatctatatgaaaacaacatgttgcacggtaacacaatgactgttaccggtgacactttggcagaacgtgcaaagaaagcaccaagcctacctgaaggacaagagattattaagccactctcccacccaatcaaggccaacggtcacttgcaaattctgtacggttcattggcaccaggtggagctgtgggtaaaattaccggtaaggaaggtacttacttcaagggtagagcacgtgtgttcgaagaggaaggtgcctttattgaagccttggaaagaggtgaaatcaagaagggtgaaaaaaccgttgttgttatcagatatgaaggtccaagaggtgcaccaggtatgcctgaaatgctaaagccttcctctgctctgatgggttacggtttgggtaaagatgttgcattgttgactgatggtagattctctggtggttctcacgggttcttaatcggccacattgttcccgaagccgctgaaggtggtcctatcgggttggtcagagacggcgatgagattatcattgatgctgataataacaagattgacctattagtctctgataaggaaatggctcaacgtaaacaaagttgggttgcacctccacctcgttacacaagaggtactctatccaagtatgctaagttggtttccaacgcttccaacggttgtgttttagatgcttga

SEQ ID NO: 566 - protein, 585 aa, Saccharomyces cerevisiae
MGLLTKVATSRQFSTTRCVAKKLNKYSYIITEPKGQGASQAMLYATGFKKEDFKKPQVGVGSCWWSGNPCNMHLLDLNNRCSQSIEKAGLKAMQFNTIGVSDGISMGTKGMRYSLQSREIIADSFETIMMAQHYDANIAIPSCDKNMPGVMMAMGRHNRPSIMVYGGTILPGHPTCGSSKISKNIDIVSAFQSYGEYISKQFTEEEREDVVEHACPGPGSCGGMYTANTMASAAEVLGLTIPNSSSFPAVSKEKLAECDNIGEYIKKTMELGILPRDILTKEAFENAITYVVATGGSTNAVLHLVAVAHSAGVKLSPDDFQRISDTTPLIGDFKPSGKYVMADLINVGGTQSVIKYLYENNMLHGNTMTVTGDTLAERAKKAPSLPEGQEIIKPLSHPIKANGHLQILYGSLAPGGAVGKITGKEGTYFKGRARVFEEEGAFIEALERGEIKKGEKTVVVIRYEGPRGAPGMPEMLKPSSALMGYGLGKDVALLTDGRFSGGSHGFLIGHIVPEAAEGGPIGLVRDGDEIIIDADNNKIDLLVSDKEMAQRKQSWVAPPPRYTRGTLSKYAKLVSNASNGCVLDA

SEQ ID NO: 567 - DNA, 1752 bp, Kluyveromyces lactis
atgttttcacagtctgctgtaagaaggttttcaaccactagaaatgtgggcaagaagttgaacaagtactcgcatatcatcaccgaaccaaaggaccagggtgcatcgcaagcgatgctttatgccacggggtttaaggaagacgatttcggcaaggctcaagttggtgttggttcatgttggtggtctggtaatccatgtaatatgcatttgatggatttcaacaacagaatcaccgaatccgttaacaaggctgggttgaaaggtatgcaattcaataccattggtgtttctgatggtatttccatgggtaccaagggtatgagatattctttgcaatctagagaagttattgctgattcgttcgaaaccattatgatggctcaacattacgatgccaatatcgccattccatcttgtgataaaaacatgcctggtgttttgatggctatgggtagacataacagaccttccattatggtttatggtggtaccattttgccaggttctccaacttgtggttctgctaagattccaaagaagattgacgttgtttctgcgttccagtcctatggtcaatacttatccaaggaatttactgaaactgaaagacaagatgttgtgcaacatgcttgtccaggtccaggttcttgtggtggtatgtacactgctaacaccatggcctctgtggccgaagtcttgggtatgactttgccaaactcttcctctttcccagcagtttcaaaggaaaaattgaacgaatgtgacactatcggtgaagctatcaagaagactatggaactaggaattactcctcgtgacgttatgaccaaagaagctttcgaaaacgctatgacatatgtcattgctaccggtggttccactaacgctgttcttcatatggttgctgtcgctcactctgccggtgtcaagattactccagatgatttccaaagaattagtgacaagactccattgttgggtgatttcaaaccttctggtaaatatgtgatggcagatttgattaccgtcggtggtacccaagctgttatcaaatacttgtacgaagaaggcttcctacatggtaacactattaccatctccggtgacactttagcagaaagagcagctaaggctgtatctttgaaggatggtcaagacatcattcgtcctctaactaacccaattaagacaagtggtcatttacaaattctatacggaagtttggccccaggtgggtcagtcggaaaaattactggtaaagaaggtacttacttcaagggtaaggctagagtattcaacgacgaaccaggctttatttctgctttagaaaacggtgaaatcaagaagggtgaaaaaaccgttgtcattatcagatacgaagggccaagaggtggtccaggtatgcctgaaatgttaaagccatcttctgcattgatgggttacggtctaggtaaggatgttgctctattgactgacggtagattctccggtggttctcacggtttcttgatcggtcacatcgtcccagaagctgccgaaggtggtcctatcggtttggttcgtgacggtgacgaaattatcattgatgctgataacaacaagattgacttgttagttccagaagaagaaatcgctgaacgtagaagtacatggactgctccacctccacgttatactagaggatgtttatccaagtacgcaaaattggtttcaaatgcttcccatggttgcgtgactgatttgaactaa

SEQ ID NO: 568 - protein, 583 aa, Kluyveromyces lactis
MFSQSAVRRFSTTRNVGKKLNKYSHIITEPKDQGASQAMLYATGFKEDDFGKAQVGVGSCWWSGNPCNMHLMDFNNRITESVNKAGLKGMQFNTIGVSDGISMGTKGMRYSLQSREVIADSFETIMMAQHYDANIAIPSCDKNMPGVLMAMGRHNRPSIMVYGGTILPGSPTCGSAKIPKKIDVVSAFQSYGQYLSKEFTETERQDVVQHACPGPGSCGGMYTANTMASVAEVLGMTLPNSSSFPAVSKEKLNECDTIGEAIKKTMELGITPRDVMTKEAFENAMTYVIATGGSTNAVLHMVAVAHSAGVKITPDDFQRISDKTPLLGDFKPSGKYVMADLITVGGTQAVIKYLYEEGFLHGNTITISGDTLAERAAKAVSLKDGQDIIRPLTNPIKTSGHLQILYGSLAPGGSVGKITGKEGTYFKGKARVFNDEPGFISALENGEIKKGEKTVVIIRYEGPRGGPGMPEMLKPSSALMGYGLGKDVALLTDGRFSGGSHGFLIGHIVPEAAEGGPIGLVRDGDEIIIDADNNKIDLLVPEEEIAERRSTWTAPPPRYTRGCLSKYAKLVSNASHGCVTDLN

SEQ ID NO: 569 - DNA, 1770 bp, Candida albicans
atgagttttgtcaaatcttgcagagggtgtcttaggacatttgctacatccacaatcaagcatgagaaaaagttaaacaagtactcgtctattgtcacaggcgacccatctcagggtgcttcccaagcaatgctttatgccactggtttcagtgatgaagatttcgatcgtgcacaaatcggtgtcggttctgtttggtggtcaggtaacccatgtaacatgcacttgatggagttgaacaacaggtgttccgaatcagtcaacaaggccggcttaaaagccatgcaattcaactccattggtgtgtcggacggtatcaccaacggaactgaaggtatgaagtactctttacagctgagagaaattatcgccgactcctttgaaaccatgaccatggcccaactatatgacggtaacattgccattccttcatgtgataaaaatatgcccggggtattgatggctatgggaagacacaacagacctgccattatggtctatggtggtactatcttgcctggatctccaacttgcggaacccaaaaccctgctgtagccgacaaaatcgatatcattagtgctttccaatcctacggacaatacttgtcaaaacaaatcaacaacgaagaaagaatagatattgtcaaacatgcctgtccagggcccggtgcatgtggtggtatgtacactgccaacactatggcctctgcctctgaagtcttggggttgaccttaccattttcgtcctcgtccccggcagtctccaaagaaaaagccgaagagtgtgccaacgtcgggttcgccttaaagaatttgttagagttggacttgaaaccaagagatattgtcaccaaaaaatcatttgaaaacgctattgcttatatcattgccactggtggttctactaatgccgttttacatcttattgccattgcctcttcatttgacattactattactgttgacgatttccaaagaatctccgacaacactcccttgttggccgatttcaaaccatcgggtaaatacgttatggccgacttgcaaaatgtcggcggtacacctgctgttatgaaatacttgatcaaagaaggcattatcgacggtacccaattgagtgtcaccggtaaaaccatcaacgaaaacttggctaaacttgctgatttgcctgagggccaagacattgttagaccagtatcaaacccattgaagccaagtggccacttacaaatcttgaaaggtactttggctccagggtctgctgtcgctaaaatcaccggtaaagaaggtacttatttcaaaggtaaagctagagtattcaacgacgaaggtgcatttattgttgccttggaaaatggcgagatcaaaaaaggcgaaaaaacagtttgtgtgatcagatacgaaggtccaaaaggtggtccaggtatgccagaaatgttgaaaccttcgtctgcattaatgggttacgggttaggtaaagacgttgctttgttgactgatggtagattttcgggtggttcccacgggttccttattggccacattgttcctgaagccgctgaaggtggtccaattgctttggttgaagatggcgatattattgtcatcgacgcagacaataacaaaatcgatttgttggttgagccagacgtcttgaccgaaagaagaaaacactggacgcctccagaaccaagatacaaaagaggtactttggccaaatacgccaagttggtcagcgatgcatctaagggatgtgttacagatttataa

SEQ ID NO: 570 - protein, 589 aa, Candida albicans
MSFVKSCRGCLRTFATSTIKHEKKLNKYSSIVTGDPSQGASQAMLYATGFSDEDFDRAQIGVGSVWWSGNPCNMHLMELNNRCSESVNKAGLKAMQFNSIGVSDGITNGTEGMKYSLQSREIIADSFETMTMAQLYDGNIAIPSCDKNMPGVLMAMGRHNRPAIMVYGGTILPGSPTCGTQNPAVADKIDIISAFQSYGQYLSKQINNEERIDIVKHACPGPGACGGMYTANTMASASEVLGLTLPFSSSSPAVSKEKAEECANVGFALKNLLELDLKPRDIVTKKSFENAIAYIIATGGSTNAVLHLIAIASSFDITITVDDFQRISDNTPLLADFKPSGKYVMADLQNVGGTPAVMKYLIKEGIIDGTQLSVTGKTINENLAKLADLPEGQDIVRPVSNPLKPSGHLQILKGTLAPGSAVAKITGKEGTYFKGKARVFNDEGAFIVALENGEIKKGEKTVCVIRYEGPKGGPGMPEMLKPSSALMGYGLGKDVALLTDGRFSGGSHGFLIGHIVPEAAEGGPIALVEDGDIIVIDADNNKIDLLVEPDVLTERRKHWTPPEPRYKRGTLAKYAKLVSDASKGCVTDL

SEQ ID NO: 571 - DNA, 1815 bp, Pichia stipitis
atgagttttttatttaaggctgctgccgcacgccgtgttgcctccaagtcgcctgctgctgtggccagatcgttttctgtctctgctactcaatgtgaaaagaaattgaacaagtactcttcgattgtcactggtgatccctcccagggtgcttcgcaagccatgctctatgccacaggtttcgacgatgccgacttcaacagagcccagatcggtgtgggctcagtttggtggtcaggtaatccttgcaacatgcacttgatggagttgaacaacaagtgtactgaatcagtcaacagagctggtttgaagggaatgcaattcaactcgattggtatttccgatgggatcactaacggaactgaaggaatgagatactctcttcaatctcgtgaaattattgctgactcgttcgaatccatgatgcttggtcaattgtacgatggtaacattgccattccatcctgtgacaagaatatgcctggtgtcttgattgctatggccagacacaacagaccttctattatggtctatggtggtacaatcttgccaggtcaaactacttgcggaaccaacaacccagctatcgccgacaaaattgatatcatctcagctttccagtcgtatggacagtacttgaccaagtccatcactaacgaagaaagaaaggatatcgttagacacgcctgtcctggtcctggtgcctgtggtggtatgtatactgctaacaccatggcatctgcagctgaatgtcttggtatgtctttgccctattcatcttcggctccagccgtctcaaaggaaaaggatgctgagtgtgccaacatcggtcaagccatcaagcacttgttggagatcgacttgaagccccgtgatattttgactaagaaatctttcgaaaacgctatcgcttatatcattgctactggtggatctacgaatgctgtattgcacttaattgccattgcttcctcagctgatattgatcttaccgtagatgatttccagagaatctccgactccactccgttgttggcagacttcaagccatcgggacaattcgtaatggcagacttacagaagtacggtggtactccagccgtgatgaaattcttgatgaacgaaggcttcattgacggagaccagtacactgtcactggtaagaccatcaaggaaaatttggcttccgtcaaggacttgcctgctgatcagcctatcatcagaccagtcagcaaccccttgaagacaagcggtcacttgcaaatcttgaagggttccttggctccaggttctgctgtcggtaagatcaccggtaaggaaggtacctacttcaagggtaaggctcgtgtctttgatgacgaaggagacttcattgtcgccttggagaagggtgagattaagaagggtgaaaagaccgtctgtgtcatcagatacgaaggtccaaaaggaggccccggtatgcctgaaatgttgaagccttcctcggccttgatgggttatggtttaggtaaagatgttgctcttttgacagacggtaggttctctggtggatcccacggcttcttgattgggcacattgttcctgaagctgctgaaggtggacctatcggtttggtgtacgatggtgacgaaatcgtcattgatgccgaaaacaacaagatcgacttgttagtagacgaagctgtgttggctgaaagaagaaagttatggactgctcctgagccaagatacaccaggggtactttggccaagtacgccagattggtcagtgacgcttctgctggatgcgttaccgacttgccaataaagaattaa

SEQ ID NO: 572 - protein, 604 aa, Pichia stipitis
MSFLFKAAAARRVASKSPAAVARSFSVSATQCEKKLNKYSSIVTGDPSQGASQAMLYATGFDDADFNRAQIGVGSVWWSGNPCNMHLMELNNKCTESVNRAGLKGMQFNSIGISDGITNGTEGMRYSLQSREIIADSFESMMLGQLYDGNIAIPSCDKNMPGVLIAMARHNRPSIMVYGGTILPGQTTCGTNNPAIADKIDIISAFQSYGQYLTKSITNEERKDIVRHACPGPGACGGMYTANTMASAAECLGMSLPYSSSAPAVSKEKDAECANIGQAIKHLLEIDLKPRDILTKKSFENAIAYIIATGGSTNAVLHLIAIASSADIDLTVDDFQRISDSTPLLADFKPSGQFVMADLQKYGGTPAVMKFLMNEGFIDGDQYTVTGKTIKENLASVKDLPADQPIIRPVSNPLKTSGHLQILKGSLAPGSAVGKITGKEGTYFKGKARVFDDEGDFIVALEKGEIKKGEKTVCVIRYEGPKGGPGMPEMLKPSSALMGYGLGKDVALLTDGRFSGGSHGFLIGHIVPEAAEGGPIGLVYDGDEIVIDAENNKIDLLVDEAVLAERRKLWTAPEPRYTRGTLAKYARLVSDASAGCVTDLPIKN

SEQ ID NO: 573 - DNA, 1705 bp, Yarrowia lipolytica
ctacgctactaaggcgcacactttgaacaagttctccaagatcatcacggagcccaagtcgcagggagcctctcaggctatgctgtacgcctgcggcttcaacgaggccgatctgggcaagccccaggttggtgtcgcctccgtctggtggtccggaaacccctgcaacatgcacctgcttgatctcaacttcaaggtcaaggagggcatcgagaagcacaacctcaaggccatgcagttcaacactattggtgtgtctgatggtatttctatgggtaccaagggtatgcgatattctctgcaatctcgagacatgattgctgactccattgagactctcatgatggcccagcactacgacgccaacatctccatcccgggctgtgacaagaacatgcccggtgttctcatggccatgggccgagtcaaccgaccctccatcatgctgtacggaggaaccatccaccccggaaaggccgagactcgaaagggcgaggacattgatattgtttccgccttccaggcctacggacagtacattgccggcggcatctctgagaccgagcgagccgatgttattcgacacgcctgccccggtcagggagcctgtggaggtatgtacactgctaacaccatggcttctgccgcagaggtgcttggtatgactctgcctggctcctcctccgctcccgccatctccaaggagaagatggccgagtgtgaggctctgggacctgccatcaacaagctgctggagatggacctcaagcctaaggatatcatgacccgacaggcctttgagaacgctattgcttacatcattgccactggaggctccaccaacgccgttctccatctgctggctatcgctcacaccgtcgacgttcctttgaccattgacgacttccagcgaatctccgataacactcctctgctcgccgacttcaagccctccggagctcacgtcatggccgatctgcagaagtggggtggaacccccgccgtcatcaagatgctcattgagcagggtttcattgatggctctcccatgacctgttccggagagtctctcaaggacaccgtcgccaagtacccctctctccccaaggagcaggatatcttcgcctctgttgacgctcccctcaagccctctggtcatctgcagattcttaagggctcccttgctcccggtggatccgtcggaaagatcaccggaaaggagggaacattcttcaagggtaccgcccgatgtttcgacgaggaggacctgttcattgaggctctggagaagggcgagatcaagaagggcgagaagacctgtgtcattattcgatacgagggccccaagggaggacccggtatgcccgagatgctcaagccctcttctgccctgatgggatacggtctgggcaaggatgttgctctgctgaccgacggacgattctccggaggatctcatggtttcctcattggtcacattgtccccgaggcttacgagggaggtcccattggtctggttgaggacggcgatgagatcatcatcgacgctgacaacaacatcatcgacctgcttgttgatgagaagaccatggctgagcgaaaggccaagtggactccccccgctcctcgatacacctctggaaccctgcacaagtactccaagcttgtgtccgacgcctccactggctgtatcactgacgcctaa

SEQ ID NO: 574 - protein, 567 aa, Yarrowia lipolytica
YATKAHTLNKFSKIITEPKSQGASQAMLYACGFNEADLGKPQVGVASVWWSGNPCNMHLLDLNFKVKEGIEKHNLKAMQFNTIGVSDGISMGTKGMRYSLQSRDMIADSIETLMMAQHYDANISIPGCDKNMPGVLMAMGRVNRPSIMLYGGTIHPGKAETRKGEDIDIVSAFQAYGQYIAGGISETERADVIRHACPGQGACGGMYTANTMASAAEVLGMTLPGSSSAPAISKEKMAECEALGPAINKLLEMDLKPKDIMTRQAFENAIAYIIATGGSTNAVLHLLAIAHTVDVPLTIDDFQRISDNTPLLADFKPSGAHVMADLQKWGGTPAVIKMLIEQGFIDGSPMTCSGESLKDTVAKYPSLPKEQDIFASVDAPLKPSGHLQILKGSLAPGGSVGKITGKEGTFFKGTARCFDEEDLFIEALEKGEIKKGEKTCVIIRYEGPKGGPGMPEMLKPSSALMGYGLGKDVALLTDGRFSGGSHGFLIGHIVPEAYEGGPIGLVEDGDEIIIDADNNIIDLLVDEKTMAERKAKWTPPAPRYTSGTLHKYSKLVSDASTGCITDA

SEQ ID NO: 575 - DNA, 1752 bp, Candida glabrata
atgtcctccagactaacttttgctaggaagttctccagcacaagaaatgttgcaaagaaactgaataaatactcatatatcatcactgagcctaaggaccaaggtgcctctcaggctatgttgtatgccactggtttcaacaaggatgatttcagcaaagcgcaagttggtgttggttcttgttggtggtctggtaacccatgtaacatgcatctattggatttgaaccacagatgttcccaatccatcgagaaagccggtatgaaaggtatgcaatttaacacaattggtgtctctgacggtatctcgatgggtactaaaggtatgagatattctttacaaagtagagaaattatcgcagactctttcgagactatcatgatggcacaacactacgatgccaatattgctattccatcctgtgacaagaatatgcctggtgttatgatggctatgggtagacacaacagaccatctattatggtttatggtggtaccattatgccaggtcacccaacttgtggctccaagaacattccagagaacattgatgttgtctctgctttccaatcctacggtcaatacatctcgaagcaattcaatgaagaagagagaagtgatgttgtacaacactcttgtccaggtcctggctcttgtggtggtatgtacaccgccaacaccatggcctctgctgccgaagttttaggtatcactatgccaaactcttctgctttcccagctgtttctgctgaaaagattgctgaatgtgacaacattggtgctgctatcaagaacactatggaacttggtattaccccacgtcaaatcttcaccaaggaatcctttgaaaacgctatcacttacgtcattgctactggtggttccactaacgcagttcttcacttggtagctattgcacactctgctggtgtcaagatcaccccagatgatttccaaaggatcagtgacaagacaccattgctaggtgacttcaagccatctggtaagtatgtcatggccgatttgattaaggtcggtggtactcaaagtgtcatcaagttcttgtatgacaacggtttcttatacggtgacgccttaactgttactggtgaaactttggctgagcgtgccaagaaagccaagggtctaagtgaaactcaagacattattagaccattgtcaaacccaattaagccaagtggccatctacaaattctatacggttctcttgctccaggtggttctgttggtaagattactggtaaggaaggtacttacttcaaaggtaaggctcgtgttttcgaagaagaagacgctttcatctctgcattggagaatggtgaaatcaagaaaggtgaaaagacagttgttattatcagatatgaaggtccaaagggtggtccaggtatgccagaaatgttgaagccatctagtgcactaatgggttatggtctaggtaaagatgttgccttgctaactgatggtagattctctggtggttctcatggtttcttgattggtcacattgttccagaagctgccgaaggtggtccaattggtttggtcagagatggtgatgaaattgtgattgatgcagacaacaacaagattgacctcctaatctctgaatctgagatgtctcaacgtaaggccgaatggaaacctccagccccacgttacaacaggggtactctatccaaatatgctaagttagtctctaatgcctcccaaggttgtgttacagacgcttaa

SEQ ID NO: 576 - protein, 583 aa, Candida glabrata
MSSRLTFARKFSSTRNVAKKLNKYSYIITEPKDQGASQAMLYATGFNKDDFSKAQVGVGSCWWSGNPCNMHLLDLNHRCSQSIEKAGMKGMQFNTIGVSDGISMGTKGMRYSLQSREIIADSFETIMMAQHYDANIAIPSCDKNMPGVMMAMGRHNRPSIMVYGGTIMPGHPTCGSKNIPENIDVVSAFQSYGQYISKQFNEEERSDVVQHSCPGPGSCGGMYTANTMASAAEVLGITMPNSSAFPAVSAEKIAECDNIGAAIKNTMELGITPRQIFTKESFENAITYVIATGGSTNAVLHLVAIAHSAGVKITPDDFQRISDKTPLLGDFKPSGKYVMADLIKVGGTQSVIKFLYDNGFLYGDALTVTGETLAERAKKAKGLSETQDIIRPLSNPIKPSGHLQILYGSLAPGGSVGKITGKEGTYFKGKARVFEEEDAFISALENGEIKKGEKTVVIIRYEGPKGGPGMPEMLKPSSALMGYGLGKDVALLTDGRFSGGSHGFLIGHIVPEAAEGGPIGLVRDGDEIVIDADNNKIDLLISESEMSQRKAEWKPPAPRYNRGTLSKYAKLVSNASQGCVTDA

SEQ ID NO: 577 - DNA, 1815 bp, Chlamydomonas reinhardtii
atgtcgtcgactgcgaccatgcccggccagcgctcggccatgaaggccgctggcgcccagagccgccgtgccgtgaaggtgatggccgtgtccgctccggagaagccgtcgtcgtccgccccggccgtcccggcaggcctgaacaagttcagcagccgcatcacgcaacccaagtaccagggcgcgtctcaggccatgctgttcgctaccggtctgcgggaggaggacatgatcaagccgcaggtgggcatctcctcggtgtggtacgagggcaacccttgcaacatgcacctgatggacctggcggcggaggtgaagaagggcgtggaggccatgggcatggtgggcttccgcttcaacaccattggtgtcagcgacggcatttccatgggcaccgacggcatgagcttcagcctgcagagccgcgacctgattgccgactccattgagacggtcatgagcgcgcagtggtacgacgccaacatctcgctgcccggctgcgacaagaacatgcccggcacgctgatggccatggcccgcctgaaccgcccctcgctcatgatctacggcggcactatcaagcccggccacagccgcatggacggctccgtgctggacatcgtgtccgccttccagagctacggcgcctactcggccggcctgatcaacgaggcccagcgtgtggacattgtgcgcaacagctgccctggcgctggcgcgtgcggcggcatgtacactgccaacaccatggcctcggccattgaggctctgggcatgaccctgccctacagctcgtccatccccgctgaggacccgctgaagaaggacgagtgccgcatggccggccgctacatgctggagctgctcaagtccgacctgaagcctctggacatcatgacctacaaggcctttgagaacgccatggtgctggtcatggccaccggcggctccaccaacgccgtgctgcacttcatcgccatggcgcgcgcctgcggcgtgcccctgaccctggacgacttccagcgcgtgtctgaccgcacgcccttcatctgcgacctcaagccctcgggccgctacgtcatggaggacatccacaaggtgggcggcacccccgccgtgctgaagtacctggactccaagggctacatcaaccgcgactgcatgaccgtcactggcaagaccatgggcggcaacctggcggaggtgccggagctgcgtgcgggccaggacgtggtgctgcccgtggagaagcccatcaagcagactggccacatccagatcctgtacggcaacctggccccggagggcagcgtggccaagatcactggcaaggagggcctgctgttcgagggcgaggcgctggtgtttgacaacgaggaggacatgatcaccatggtgggcgccgagcccaacaagttccgcggcaaggtggtggtgatccgctacgagggccccaagggcggccccggcatgcccgagatgctcacgcccacctccgccatcatgggcgccggcctgggcaaggagtgcgcgctcatcaccgacggacgcttcagcggcggcagccacggcttcgtgatcggccacgtcacgcccgaggcgcaggtcggcggccccatcgccctggtcaagaacggcgacaagattgtgattgatgtggagaagcgcgtgatggacatgaagatctccgaccaggagctggccgcgcgcaaggctgcctggaaggcgcccccgctgaaggccaccagcggcaccctgtacaagtacatcaagaacgtgtcgtcggcgtccactggctgcgtcaccgactcgtaa

SEQ ID NO: 578 - protein, 604 aa, Chlamydomonas reinhardtii
MSSTATMPGQRSAMKAAGAQSRRAVKVMAVSAPEKPSSSAPAVPAGLNKFSSRITQPKYQGASQAMLFATGLREEDMIKPQVGISSVWYEGNPCNMHLMDLAAEVKKGVEAMGMVGFRFNTIGVSDGISMGTDGMSFSLQSRDLIADSIETVMSAQWYDANISLPGCDKNMPGTLMAMARLNRPSLMIYGGTIKPGHSRMDGSVLDIVSAFQSYGAYSAGLINEAQRVDIVRNSCPGAGACGGMYTANTMASAIEALGMTLPYSSSIPAEDPLKKDECRMAGRYMLELLKSDLKPLDIMTYKAFENAMVLVMATGGSTNAVLHFIAMARACGVPLTLDDFQRVSDRTPFICDLKPSGRYVMEDIHKVGGTPAVLKYLDSKGYINRDCMTVTGKTMGGNLAEVPELRAGQDVVLPVEKPIKQTGHIQILYGNLAPEGSVAKITGKEGLLFEGEALVFDNEEDMITMVGAEPNKFRGKVVVIRYEGPKGGPGMPEMLTPTSAIMGAGLGKECALITDGRFSGGSHGFVIGHVTPEAQVGGPIALVKNGDKIVIDVEKRVMDMKISDQELAARKAAWKAPPLKATSGTLYKYIKNVSSASTGCVTDS

SEQ ID NO: 579 - DNA, 1704 bp, Ostreococcus lucimarinus
atgcccgacggcgacgcgagcgatttgaacaagtggtcgagaaagatcacgcaaccgaagagccaaggagcgtcgcaggcgatgctgtacgccacgggcctgacggaggccgatatgaacaaaccgcagatcggcgtgtcctcggtgtggtggcagggaaacccttgtaacaaacacttgctggacctggcgggtaaagtggcggaaggcgtcaaggcggcggatatggtgagctttcagtttaacaccgtgggggtgtcggacgggatttccatgggtacgccgggcatgtccttctcgttgcaatcgcgggatttgatcgcggatagcatcgagaccgtgatgggtggacagtggtacgacggaaatatttctctcccggggtgcgataagaacatgccgggtacgatcatggccatgggtcgattgaaccgcccgtcgctgatgatttacggcggtaccattcgccctggccactccgccgtggatggtggcacactcgatatcgtatccgcgttccaatcgtacggacagttcgttaccggcgctatcacggaggaacagcgcaaagacatcgtgcgtaactcttgcccgggctctggcgcgtgcggcggcatgtacaccgccaacaccatggccagctgcatcgaggctctcggcatgactcttccgtattcttcctccattcccgcggaagatcctctcaagatggatgaatgtttcatggctggcgctgcgatgaagcatttgctcgaaatcgacctgaagccgcgtgacatcatgactcgcgcggcgttcgaaaacgccatggtcaccgtcatcgctctcggcggttccaccaacgcggttcttcacttgatcgcgatggcgcactctgtcggcatcaaattgactctggacgacttccaagccgtctccaacaagacgccgttcatcgctgacttaaagccgtccggtaagtacgtcatggaggacgtccacaaggttggcggcactccggcggtgttgaagtatttgatgtctgaaggcatgattgacggttcttgcatgactgtcaccggtaagaccctcgccgagaacctcgccatctgcccggatttgacgccggggcaagatgttattctcccggtgagcacgcccatcaagaagactggtcacttgcaatgcttgtacggcaacatcgcccagggaggctccgtggcgaagatcaccggtaaggaaggcttgtactttaaaggcttcgcgaagtgctacgatagcgaagaggaaatgctcgaggccttggcggcagactccgagtctttcaagggtagcgtcatcgtcattcgctacgaaggtccgaagggtggtccgggcatgccggagatgctcacgccgacgtcggccatcatgggtgccggtctcgggaacgactgcgcgctcatcacggatggtcgattctccggtggctcgcacggtttcgtcatcggtcacgttacgccggaagcgcaagttggtggtaacatcggtttgatcaaggacggtgatatcatcgaaattgatgccgaagttcgcaccatcaacgcgccggatgtcaccgacgccgagtgggaaaagcgtcgagcggcgtggaaggcgccgcctttggaagcgacgtcgggtacgctctacaagtactgcaagctcgtcgccagcgcttcggaaggctgcatcacggacttgtga

SEQ ID NO: 580 - protein, 567 aa, Ostreococcus lucimarinus
MPDGDASDLNKWSRKITQPKSQGASQAMLYATGLTEADMNKPQIGVSSVWWQGNPCNKHLLDLAGKVAEGVKAADMVSFQFNTVGVSDGISMGTPGMSFSLQSRDLIADSIETVMGGQWYDGNISLPGCDKNMPGTIMAMGRLNRPSLMIYGGTIRPGHSAVDGGTLDIVSAFQSYGQFVTGAITEEQRKDIVRNSCPGSGACGGMYTANTMASCIEALGMTLPYSSSIPAEDPLKMDECFMAGAAMKHLLEIDLKPRDIMTRAAFENAMVTVIALGGSTNAVLHLIAMAHSVGIKLTLDDFQAVSNKTPFIADLKPSGKYVMEDVHKVGGTPAVLKYLMSEGMIDGSCMTVTGKTLAENLAICPDLTPGQDVILPVSTPIKKTGHLQCLYGNIAQGGSVAKITGKEGLYFKGFAKCYDSEEEMLEALAADSESFKGSVIVIRYEGPKGGPGMPEMLTPTSAIMGAGLGNDCALITDGRFSGGSHGFVIGHVTPEAQVGGNIGLIKDGDIIEIDAEVRTINAPDVTDAEWEKRRAAWKAPPLEATSGTLYKYCKLVASASEGCITDL

SEQ ID NO: 581 - DNA, 1695 bp, Vitis vinifera
atgcaagcagctctgataaccccttctcctcgcgccattcccaccggttccatcactgccacgagaaccacaattccccctcatgtgcgcctcgtgtctgtccgagcatcgaccgaggtagcccaatcgccgccacccgcagtgaaagagacggcccacaagctcaacaagtacagctctcatgtcaccgagcccaagtcccagggcggctcacaagccatcctctatggcgtgggtctctcggatgaggacatgcacaagcctcaaatcggtatatcatcggtttggtacgagggcaacacctgcaacatgcatttgttgaagctttcagaggctgtgaaggagggggtgagagatgccggcatggttgggttcaggttcaacactgttggtgtcagcgatgccatctcaatgggcacgagaggcatgtgctatagcttgcagtctagggatttgattgctgatagtattgagacggtcatgtctgctcagtggtatgatggcaacatttctattcccggttgtgacaaaaatatgccaggtacaataatggcaatgggacggctcaatcgacctagtattatggtttatggtggagctatcaagcctggtcattttcaaggccatacttacgacataatatctgcctttcaggtttatggagagttcgtcagtgggtccataactgatgaacagaggatgaatgttgtccgaaattcatgcccaggagcaggagcttgtggtggaatgtatacagccaatacgatggcttctgctattgaagttatgggaatgtctcttcccttcagctcttcaacaccggctgaagacccattgaagttgcatgagtgccatttggctggaaaatatcttctggatttgataaaaatggacttaaaaccacgagatattatcactatgaagtcactacggaatgctatggttgttgtcatggcattgggtggatctaccaatgctgtattacatttaattgccattgcaaggtctgttggtctgcagttaactcttgatgattttcagaaagtaagtgatgaggttccattccttgctgatcttaagcccagtggcaaatacgtcatggaggacatacacaagattggaggaacaccggcaatcattcgcttccttttggaaaatgggtttttagatggggattgtataacagttactgggaagacattggctgaaaatgcagaactttttccttctttgcccagagatcagcaaataataagaccgttggcaaaccccataaagaagactggacacctccaaactttatatggaaatcttgcaccagagggttctgttgcaaaaattactggaaaagaagggctatatttctctggtcctgcacttgtctttgaaggtgaggaagctatgattgcagctatagcagagaatcctatgagctttaaggggaaagtagttattattagaggagagggacccaagggggggccaggaatgcctgaaatgttgactccaacaagcgcaataatgggagcaggtcttgggaaggatgttgctttgttgactgatggtaggttttcaggaggttcacatggatatgttgttggccacatatgtcctgaagcacatgtacattttcttttccttcatccagttttatttttttatttttttgatcagaaacgaagaagattatattaa

SEQ ID NO: 582 - protein, 564 aa, Vitis vinifera
MQAALITPSPRAIPTGSITATRTTIPPHVRLVSVRASTEVAQSPPPAVKETAHKLNKYSSHVTEPKSQGGSQAILYGVGLSDEDMHKPQIGISSVWYEGNTCNMHLLKLSEAVKEGVRDAGMVGFRFNTVGVSDAISMGTRGMCYSLQSRDLIADSIETVMSAQWYDGNISIPGCDKNMPGTIMAMGRLNRPSIMVYGGAIKPGHFQGHTYDIISAFQVYGEFVSGSITDEQRMNVVRNSCPGAGACGGMYTANTMASAIEVMGMSLPFSSSTPAEDPLKLHECHLAGKYLLDLIKMDLKPRDIITMKSLRNAMVVVMALGGSTNAVLHLIAIARSVGLQLTLDDFQKVSDEVPFLADLKPSGKYVMEDIHKIGGTPAIIRFLLENGFLDGDCITVTGKTLAENAELFPSLPRDQQIIRPLANPIKKTGHLQTLYGNLAPEGSVAKITGKEGLYFSGPALVFEGEEAMIAAIAENPMSFKGKVVIIRGEGPKGGPGMPEMLTPTSAIMGAGLGKDVALLTDGRFSGGSHGYVVGHICPEAHVHFLFLHPVLFFYFFDQKRRRLY

SEQ ID NO: 583 - DNA, 1839 bp, Vitis vinifera
atgcaagtagctctgataaccccttctcctcgcgccattcccaccggttccatcactgccacgagaaccacaattccccctcatgtgcgcctcgtgtctgtccgagcatcgaccgaggtagcccaatcgccgccacccgcagtgaaagagacggcccacaagctcaacaagtacagctctcatgtcaccgagcccaagtcccagggcggctcacaagccatcctctatggcgtgggtctctcggatgaggacatgcacaagcctcaaatcggtatatcatcggtttggtacgagggcaacacctgcaacatgcatttgttgaagctttcagaggctgtgaaggagggggtgagagatgccggcatggttgggttcaggttcaacactgttggtgtcagcgatgccatctcaatgggcacgagaggcatgtgctatagcttgcagtctagggatttgattgctgatagtattgagacggtcatgtctgctcagtggtatgatggcaacatttctattcccggttgtgacaaaaatatgccaggtacaataatggcaatgggacggctcaatcggcctagtattatggtttatggtggagctatcaagaggcagattgacaattataattgggatcccaatcataccatcctgtgtagtgtggcacaccactttatactgagatatgaaatgttgtatgaagtcatctttgagaaatggcatgatcctggtcattttcaaggccatacttacgacataatatctgcctttcagctatggtctgaaggaggtgtatgtgtagtatcacttgtcccatggtttatggagagttcgtccagtgggtccataactgatgaacagaggatgaatgttgtccgaaattcatgcccaggagcaggagcttgtggtggaatgtatacagccaatacgatggcttctgctattgaagttatgggaatgtctcttcccttcagctcttcaacaccggctgaagacccattgaagttgcatgagtgccatttggctggaaaatatcttctggatttgataaaaatggacttaaaaccacgagatattatcactatgaagtcactacggaatgctatggttgttgtcatggcattgggtggatctaccaatgctgtattacatttaattgccattgcaagaattgctcatgataagattcttggcaggtctgttggtctgcagttaactcttgatgattttcagaaagtaagtgatgaggttccattccttgctgatcttaagcccagtggcaaatatgtcatggaggacatacacaagattggaggaacaccggcaatcattcgcttccttttggaaaatgggtttttagatggggattgtataacaggtcctgcacttgtctttgaaggtgaggaagctatgattgcagctatagcagagaatcctatgagctttaaggggaaagtagttattattagaggagagggacccaaggggggcccaggaatgcccgaaatgttgactccaacaagcgcaataatgggagcaggtcttgggaaggatgttgctttgttgactgatggtaggttttcaggaggttcacatggatatgttgttggccacatatgtcctgaagcacatgaaggtggtcccattggtctcattgaaaatggagatatcatcacaattgatgtccaaaaaaggagaatggatgtccagctgacagatgaagagatgaatgagcgaagaaagaaatggagtcccccaccatataaggctaaccaaggagttctatacaagtacatcaagaacgtaaaatcggcttcagatgggtgtgtgacggatgaataa

SEQ ID NO: 584 - protein, 612 aa, Vitis vinifera
MQVALITPSPRAIPTGSITATRTTIPPHVRLVSVRASTEVAQSPPPAVKETAHKLNKYSSHVTEPKSQGGSQAILYGVGLSDEDMHKPQIGISSVWYEGNTCNMHLLKLSEAVKEGVRDAGMVGFRFNTVGVSDAISMGTRGMCYSLQSRDLIADSIETVMSAQWYDGNISIPGCDKNMPGTIMAMGRLNRPSIMVYGGAIKRQIDNYNWDPNHTILCSVAHHFILRYEMLYEVIFEKWHDPGHFQGHTYDIISAFQLWSEGGVCVVSLVPWFMESSSSGSITDEQRMNVVRNSCPGAGACGGMYTANTMASAIEVMGMSLPFSSSTPAEDPLKLHECHLAGKYLLDLIKMDLKPRDIITMKSLRNAMVVVMALGGSTNAVLHLIAIARIAHDKILGRSVGLQLTLDDFQKVSDEVPFLADLKPSGKYVMEDIHKIGGTPAIIRFLLENGFLDGDCITGPALVFEGEEAMIAAIAENPMSFKGKVVIIRGEGPKGGPGMPEMLTPTSAIMGAGLGKDVALLTDGRFSGGSHGYVVGHICPEAHEGGPIGLIENGDIITIDVQKRRMDVQLTDEEMNERRKKWSPPPYKANQGVLYKYIKNVKSASDGCVTDE

SEQ ID NO: 585 - DNA, 1827 bp, Arabidopsis thaliana
atgcaagccaccatcttctctccacgcgccactctcttcccctgtaaacctctcctcccttcccacaatgtcaactctcgccgtccctcaatcatctcctgctccgcccaatccgtaaccgctgatccttcaccacctatcactgacaccaataagctcaacaaatacagctcaagaatcactgaacccaaatcccaaggtgggtctcaagcaattcttcacggtgttggtttatcagacgacgatttgctaaaaccccagattggtatctcgtcggtttggtatgaagggaacacttgtaacatgcatttgctgaaattgtctgaggctgtgaaagaaggagttgaaaatgcaggaatggttgggtttaggtttaatactattggtgtgagtgatgctatttcgatgggaacgagagggatgtgttttagtttgcaatctagggatttgattgctgatagtattgagactgttatgagtgctcagtggtatgatggtaacatatctattcccggttgtgataaaaatatgcctggaactattatggctatgggaaggcttaacagaccagggattatggtttatggtggaaccattaagcctggccattttcaagacaagacatatgacattgtatctgctttccagagttatggagaatttgttagtggctccataagtgatgaacagagaaagactgtcctccatcattcatgtcctggagctggagcctgtggtggcatgtacacagcgaatacaatggcttctgctatcgaagcaatgggaatgtcccttccttacagttcttcaatacctgctgaagacccattgaagttggacgagtgtcgcttagcaggaaaatatcttctagaattgctaaagatggacttaaaaccccgtgacattatcactccaaaatcacttcgtaatgcaatggtttccgtcatggcccttgggggatcgacaaatgcagtattgcatctaattgctattgcaaggtctgttggtttggagttgactcttgacgattttcagaaagttagcgatgcggttccatttctagcagatcttaaacccagtgggaagtatgttatggaggatatacataagataggtggtacgccagctgttctccgctatttattagagctaggattgatggatggtgattgtatgacagtgacagggcagactttggctcaaaatttagaaaacgtcccaagcttaacagaagggcaggagataattagacctctgtcaaatccaatcaaggagactggacacatacaaattttgagaggagaccttgcaccagatggttctgtagcaaaaattaccggcaaagagggcttatatttctctggtcctgcacttgtatttgaaggagaggaatctatgttggctgctatatcagcagacccaatgagttttaagggaactgtggttgttatcagaggagaggggcctaaaggaggtccaggtatgcctgagatgttgacaccgacaagtgcaataatgggtgccggtcttggaaaggaatgtgcattactgactgatggtaggttctctggtgggtcacacggttttgttgttggccacatttgccctgaagctcaggagggtggtccgatcggtctgatcaagaacggagacataatcaccattgacataggaaagaagagaatagacacacaagtctcacccgaagaaatgaatgaccgtagaaagaaatggactgctcctgcatacaaggttaaccgcggagtcctatataagtacatcaagaacgtgcaatcggcttcagatggatgtgtgactgacgagtaa

SEQ ID NO: 586 - protein, 608 aa, Arabidopsis thaliana
MQATIFSPRATLFPCKPLLPSHNVNSRRPSIISCSAQSVTADPSPPITDTNKLNKYSSRITEPKSQGGSQAILHGVGLSDDDLLKPQIGISSVWYEGNTCNMHLLKLSEAVKEGVENAGMVGFRFNTIGVSDAISMGTRGMCFSLQSRDLIADSIETVMSAQWYDGNISIPGCDKNMPGTIMAMGRLNRPGIMVYGGTIKPGHFQDKTYDIVSAFQSYGEFVSGSISDEQRKTVLHHSCPGAGACGGMYTANTMASAIEAMGMSLPYSSSIPAEDPLKLDECRLAGKYLLELLKMDLKPRDIITPKSLRNAMVSVMALGGSTNAVLHLIAIARSVGLELTLDDFQKVSDAVPFLADLKPSGKYVMEDIHKIGGTPAVLRYLLELGLMDGDCMTVTGQTLAQNLENVPSLTEGQEIIRPLSNPIKETGHIQILRGDLAPDGSVAKITGKEGLYFSGPALVFEGEESMLAAISADPMSFKGTVVVIRGEGPKGGPGMPEMLTPTSAIMGAGLGKECALLTDGRFSGGSHGFVVGHICPEAQEGGPIGLIKNGDIITIDIGKKRIDTQVSPEEMNDRRKKWTAPAYKVNRGVLYKYIKNVQSASDGCVTDE

SEQ ID NO: 587 - DNA, 1785 bp, Oryza sativa
atgcagtcgcttgccctcacctccccctcccttccggcgccggcgaccgcatccggccgccgccgccgccgcctggagcgcatccgcgccaccgcggtgtccgacgagccgaagctgaacaagtacagcgcgcgcatcacggagcccaagtcgcagggggcgtcgcaggcggtgctctacggcgtggggctcaccgacgccgacctccgcaagccgcaggtgggcgtctcctctgtctggtacgagggcaacacctgcaacatgcaccttctccgcctcgccgaggccgtcagggacggcgtccgcgaggccggcatggtggccttccgcttcaacaccgtcggggtcagcgacgccatctccatgggcacccggggcatgtgctacagcctccagtcgcgcgacctcatcgccgacagcatcgagaccgtcatgggcgcgcagcactacgacgccaacatctccattcctggatgcgacaagaacatgccaggaacaataatggcaatggggcggctgaaccgaccaagtatcatgatatatggtggaactattaagcctggtcattttcagggtaattcttatgacatagtatctgctttccagtgctatggagaatttgttaccggatcaatcagtgatgagcaaagaaagaatgtgctccgcaactcatgcccaggagcaggtgcgtgtggtggtatgtacaccgcgaacacaatggcatccgccatcgagaccatgggtatgagccttccgtacagttcttcaacccctgctgaagacccactaaagctagaggaatgccgtcttgctgggaagtatcttttagaattgttaaagatggatttgaagcctgaagacattatcactgagaaatctttgcggaacgcaatggtcattgtcatggcacttggtgggtctactaatgctgttttgcatttaattgctatcgctaggtctgtaggtctgcaattaactcttgatgattttcagaaggtcagtgaccaagttcctttccttgcggaccttaagcctagtggcaaatatgtcatggaggatctgcataagattggtggaacacctgcagtaattcattatcttctggagcaaggtcttcttgatggtgattgtatgaccgtcactgggaaaactctagcggaaaatgctaaaatcttccctcctctgtccgaaggacagcaaataataaggcccctggacaacccaatcaaatcaactggtcatatacaaatactttatggcaatcttgcaccagaaggttctgtagcaaaaattactggcaaagaggggatgtttttctcaggccctgcactagtgtttgagggtgaagaatctatgattacagctatatcagaaaacccagcgaatttcaaggggaaggtagtagtgatacgaggagaaggaccgaaaggtggaccagggatgcctgaaatgctgactccaactagtgcaataatgggtgctggtcttgggaaggagtgtgccctgctgaccgatggcagattttctggaggatcacatggatttgttgtaggccacatttgtcctgaagcacaggagggaggtccaattggtcttgttcaaaacggtgacaaaattaccattgatgttgtgaagagagtaattgatgttgaactgactgaagctgagctggaagaaagacggaggaaatggacgccgccgccacacaaggctgcccgtggagcgctttggaagtacacgaagctcgtgtcccctgcatcaagaggatgcgtcaccgatgagtag

SEQ ID NO: 588 - protein, 594 aa, Oryza sativa
MQSLALTSPSLPAPATASGRRRRRLERIRATAVSDEPKLNKYSARITEPKSQGASQAVLYGVGLTDADLRKPQVGVSSVWYEGNTCNMHLLRLAEAVRDGVREAGMVAFRFNTVGVSDAISMGTRGMCYSLQSRDLIADSIETVMGAQHYDANISIPGCDKNMPGTIMAMGRLNRPSIMIYGGTIKPGHFQGNSYDIVSAFQCYGEFVTGSISDEQRKNVLRNSCPGAGACGGMYTANTMASAIETMGMSLPYSSSTPAEDPLKLEECRLAGKYLLELLKMDLKPEDIITEKSLRNAMVIVMALGGSTNAVLHLIAIARSVGLQLTLDDFQKVSDQVPFLADLKPSGKYVMEDLHKIGGTPAVIHYLLEQGLLDGDCMTVTGKTLAENAKIFPPLSEGQQIIRPLDNPIKSTGHIQILYGNLAPEGSVAKITGKEGMFFSGPALVFEGEESMITAISENPANFKGKVVVIRGEGPKGGPGMPEMLTPTSAIMGAGLGKECALLTDGRFSGGSHGFVVGHICPEAQEGGPIGLVQNGDKITIDVVKRVIDVELTEAELEERRRKWTPPPHKAARGALWKYTKLVSPASRGCVTDE

SEQ ID NO: 589 - DNA, 1767 bp, Physcomitrella patens
atggtggtggcgtcgtcgagcgcggaaggggctgtggccgcgccgcccccgcagtccgtggaggcgccggctgggagcgccacggacagcgcgaagctgaacaagtactcaagccgcgtgacccagcctaaggcgcagggcgcctcgcaggcgattctgtacggggtggggttgtccgaggaggatatgaacaagccgcaggtgggaatctcgtcggtttggtacgagggcaacacgtgcaatatgcatttgctgcatttgtctgaggctgtgaaggagggggtgaaggaggccgggatggtggggttccgattcaacactgtgggagttagtgacgccgtgtccatgggaaccgaggggatgtgctacagcctgcagtcgcgcgatttgattgcggacagtgtggagactgttatgggcgggcagtggtacgacgccaacatttccattccggggtgtgataagaacatgcccggggtggtcatggccatggggcggctgaacaggcccagcattatgatttatgggggcaccatcaagccaggtcattttaacggacagacgctcgacatcgtttcagccttccagagctacggagagtatgtgagcgggtccatctccgaggatgagaggatggacgttgtaaggaattcttgccccggattcggagcttgtggaggaatgtacaccgccaacaccatggcgtccgccattgaagcgctaggcatgtcgctgccgtacagctcttccatccccgccgaggacccgttgaagatcgaggaatgcaaattggccgggaaatacattctggagcttctaaagcgtgacttgaagccgcgtgacattatcacccgaaagtcgctcaacaacgctatggtggttgtcatggcgctcggaggttccacgaatgcggtgcttcatctcatcgccatcgctcgttctgtgggcgttgagctcacattggacgatttccaggacgtgagcgacaagaccccgttcattgctgatcttaaacctagcgggaagtacgtgatggaggatttgcacaaaattggaggcgtgcctgccgtactgaagtacttgttagaaaaagggctaatcgacgggagctgcatgacagtcacggggaagaccatcgctgagaacctcgctgagtgcccgcccctctccgaaggtcagaagatcatcatgcctctcgaaaaccccatcaaaaaaactggtcacttgcaaattctgtggggcaaccttgctccagagggttccgttgctaaaattacaggcaaagaaggcttgtacttttctggccccgcccgtgtatttgagggagaggaagccatgctggacgctatcactgaggaccctcagagcttgaagggtactgtgatcgttatccgaggggagggtcctaagggtggcccgggcatgcctgagatgctcacccccacgagtgctgtaattggagctggacttggcaaggaagtagcgcttctgaccgacggtcgattctctggtggctctcacggcttcgttgttgggcacatctgcccagaagctcaagtaggtggcccgattgggcttgtacgtgatggagacgtgatcaccatcgacgtggagaagaggaaaatcaacgtcgatttgacggcacaagagcttgcggatcgaaaactcctgtggagagctcccccttacaaggcctctcgtggaaccctttacaagtacatcaagaatgtcaaatcagcgtccgaaggttgcgtgactgatgagtga

SEQ ID NO: 590 - protein, 588 aa, Physcomitrella patens
MVVASSSAEGAVAAPPPQSVEAPAGSATDSAKLNKYSSRVTQPKAQGASQAILYGVGLSEEDMNKPQVGISSVWYEGNTCNMHLLHLSEAVKEGVKEAGMVGFRFNTVGVSDAVSMGTEGMCYSLQSRDLIADSVETVMGGQWYDANISIPGCDKNMPGVVMAMGRLNRPSIMIYGGTIKPGHFNGQTLDIVSAFQSYGEYVSGSISEDERMDVVRNSCPGFGACGGMYTANTMASAIEALGMSLPYSSSIPAEDPLKIEECKLAGKYILELLKRDLKPRDIITRKSLNNAMVVVMALGGSTNAVLHLIAIARSVGVELTLDDFQDVSDKTPFIADLKPSGKYVMEDLHKIGGVPAVLKYLLEKGLIDGSCMTVTGKTIAENLAECPPLSEGQKIIMPLENPIKKTGHLQILWGNLAPEGSVAKITGKEGLYFSGPARVFEGEEAMLDAITEDPQSLKGTVIVIRGEGPKGGPGMPEMLTPTSAVIGAGLGKEVALLTDGRFSGGSHGFVVGHICPEAQVGGPIGLVRDGDVITIDVEKRKINVDLTAQELADRKLLWRAPPYKASRGTLYKYIKNVKSASEGCVTDE

SEQ ID NO: 591 - DNA, 1800 bp, Chaetomium globosum
atgctctctccgtctctgctgcgcactggcgctcccagggccctggccatgagccgggtcttgccttttaggaaccagtaccgtctcctatccacaacaccccgccggtatgccgacgagaagctcaaccggatttcctccaagatcacacaaccgaagtcgcagggtgcctcccaggctatgctctacggtaccggcttgaccgaggcagacatgtccaaggcccaggtcggcatctcgtccgtctggtacgagggcaacccctgcaacatgcacctgatggagctctctggccatgtccgcaacagcatcgaaaaggccgggctcgtccctatgcgcttcaacaccatcggtgtttctgacggcatcagcatgggcaccacgggcatgcgctacagcttgcagagcagagagatcatcgccgacagcatcgagacggtcatgcagggccagtggtacgacgccaacgtgtcgctgcccggctgcgacaagaacatgcctggtgtcctgatcgccatgggccgcgtcaacaggcctagcattatggtctacggtggcaccatcaagccgggctgcaccatgaagggcgagcccatcgacatcgtcagcgccttccaggcgtacggccagtacatctcgggcgagatcgacgagaagcagcgcttcgacatcatccgcaacgcctgccctggcggcggcgcctgcggtggcatgtacacggccaacaccatggcctcggcgatcgagaccctcggcatgaccctccctggcagcagcagcttcccggccgaggacgcgcgcaagaaggccgagtgcgagagcgtgggcgaggccatcaagaacctcctccgcgagaacatccggcctagcgacatcctgacccgacaggcgtttgagaacgccatggtcgtcgtcggcgtgctgggcggcagcaccaacgctgtgctgcacctcatcgccatcgccgactcggtcggcatcaagctcactatcgacgacttccaagccgtctcggaccgtatccctttactcgccgatctgaagccctcaggcaagtacgttatggaggacctgttcaagatcggcggcaccccggcgctgctcaagttcctcctcaaggagggcctcctcgacggctcgggcattaccgtgactggtaagaccatgaaggagaacgtcgccgacctgcccggcttccccgcggaccagcccatcatccgccccctaaacaacccgctcaagccgacgggccacatccagatcctgcgcggctcgctcgcccccggcgggtcggtgggcaagatcacgggcaaggagggcctccggttcgagggcacggccaaggtgtacgactacgaggatgccttcatcgaggcgctggagcggggcgagatcaagaagggcgagaagacggtggtggtgatccggtacgagggccccaagggcgggcccggcatgcccgagatgctcaagcccagctcggccatcatgggcgccgggctcggccaggacgtcgccctcatcaccgacggccgcttctccggcggcagccacggcttcctcatcggccacatcgtgcccgaggccatggaaggcgggcccatcggcctagtccgcgacggcgacaagattgtcatcgacgccgacaagcgcgtcctcgacctcgaggtgcccgccgacgaaatggcgcgccgcaaggccgagtggaaggcccccgagcccagggccaagcgcggtaccctgaagaaatacgcctcgctggtcagcgatgccagccaggggtgtgtcaccgacaaatag

SEQ ID NO: 592 - protein, 599 aa, Chaetomium globosum
MLSPSLLRTGAPRALAMSRVLPFRNQYRLLSTTPRRYADEKLNRISSKITQPKSQGASQAMLYGTGLTEADMSKAQVGISSVWYEGNPCNMHLMELSGHVRNSIEKAGLVPMRFNTIGVSDGISMGTTGMRYSLQSREIIADSIETVMQGQWYDANVSLPGCDKNMPGVLIAMGRVNRPSIMVYGGTIKPGCTMKGEPIDIVSAFQAYGQYISGEIDEKQRFDIIRNACPGGGACGGMYTANTMASAIETLGMTLPGSSSFPAEDARKKAECESVGEAIKNLLRENIRPSDILTRQAFENAMVVVGVLGGSTNAVLHLIAIADSVGIKLTIDDFQAVSDRIPLLADLKPSGKYVMEDLFKIGGTPALLKFLLKEGLLDGSGITVTGKTMKENVADLPGFPADQPIIRPLNNPLKPTGHIQILRGSLAPGGSVGKITGKEGLRFEGTAKVYDYEDAFIEALERGEIKKGEKTVVVIRYEGPKGGPGMPEMLKPSSAIMGAGLGQDVALITDGRFSGGSHGFLIGHIVPEAMEGGPIGLVRDGDKIVIDADKRVLDLEVPADEMARRKAEWKAPEPRAKRGTLKKYASLVSDASQGCVTDK

SEQ ID NO: 593 - DNA, 1791 bp, Neurospora crassa
atgctcgctccctcccttctgcgggctcaggcccccagagctctggcttctgcccgtctctccctccgctccctctccaccactccccgccgctacaatgcccaggagaagcagctcaacaaggtgtcggccaacatcacccagcccaagtctcagggtgcttcccaggccatgctctacgccaccggcctcaacgaggacgacatgaacaaggcccaggtcggtatctcgtctgtctggtatgagggcaacccttgcaacatgcaccttctcgacctctccggcctcgtcaaggagtccgttgccaaggctggcctcgtccccatgcgcttcaacaccatcggtgtctcggacggtatctccatgggtaccaccggtatgcgctacagcttgcagtcccgtgagattattgccgactccatcgagaccgtcatgaacggccagtggtacgacgccaacatctccctccccggttgcgacaagaacatgcccggtgtcctcatcgccatgggccgtgtcaaccgcccctccatcatggtctacggtggtaccatcaagcccggctgcaacatgaagggcgagaacatcgatatcgtttccgccttccaggcatacggccagtacatctccggtgagatcgacgagaagcagcgcttcgatatcatccgcaacgcctgccctggtggtggcgcctgcggtggcatgtacactgccaacaccatggccaccgccatcgagaccctcggcatgacccttcccggttcctcctcctaccccgccgagtctcccgagaagaagaacgagtgcttgagcgtcggtgaggccatcaagaacctcctccgcgaggacatccgccccaccgatatccttactcgccaggccttcgagaacgccatgatcgtcgtcaacattcttggcggttccaccaacgccgtcctccacttgattgccatcgccgactccgttggcatcaagctcaccatcgatgacttccaggccgtctccgaccgcactcctttccttgccgacctcaagccttccggcaagtgggtcatggaggaccttagcaagattggcggcacccccgcccttctcaaattcctcctcaaggagggaatcctcgacggctccggcatcacctcgaccggtaagaccatgaaggagaacgtcgagaagttccccgacttccccaccgaccaggccatcatccgccctctgtcgaaccccatcaaggaaaccggacacattcagatcctccgcggctctctcgctcccggcggttccgtcggcaagatcaccggcaaggagggtctccgtttcgagggtaaggctcgctgcttcgactacgaggacggctttattgaggctctcgagcgtggcgagatcaagaagggcgagaagaccgtcgtcgtcatccgctacgagggtcccaagggcggccctggcatgcccgaaatgctcaagccttcgtccgccattatgggctacggtctcggcaaggacgttgccctcatcactgacggccgcttctccggtggttctcacggcttcctcatcggccacattgtgcctgaggctatggagggtggccccattggtctcgtccgcgatggcgacaccatcgtcatcgacgccgagaagaaggttcttgaccttgaggttcctgaggaggagctcgccaagcgccgcaaggagtggaaggctcctgagcccaaggctaagcgtggtactctcaggaagtacgcccagctcgtcaaggatgctagctctggctgcgtcactgacgcttaa

SEQ ID NO: 594 - protein, 596 aa, Neurospora crassa
MLAPSLLRAQAPRALASARLSLRSLSTTPRRYNAQEKQLNKVSANITQPKSQGASQAMLYATGLNEDDMNKAQVGISSVWYEGNPCNMHLLDLSGLVKESVAKAGLVPMRFNTIGVSDGISMGTTGMRYSLQSREIIADSIETVMNGQWYDANISLPGCDKNMPGVLIAMGRVNRPSIMVYGGTIKPGCNMKGENIDIVSAFQAYGQYISGEIDEKQRFDIIRNACPGGGACGGMYTANTMATAIETLGMTLPGSSSYPAESPEKKNECLSVGEAIKNLLREDIRPTDILTRQAFENAMIVVNILGGSTNAVLHLIAIADSVGIKLTIDDFQAVSDRTPFLADLKPSGKWVMEDLSKIGGTPALLKFLLKEGILDGSGITSTGKTMKENVEKFPDFPTDQAIIRPLSNPIKETGHIQILRGSLAPGGSVGKITGKEGLRFEGKARCFDYEDGFIEALERGEIKKGEKTVVVIRYEGPKGGPGMPEMLKPSSAIMGYGLGKDVALITDGRFSGGSHGFLIGHIVPEAMEGGPIGLVRDGDTIVIDAEKKVLDLEVPEEELAKRRKEWKAPEPKAKRGTLRKYAQLVKDASSGCVTDA

SEQ ID NO: 595 - DNA, 1788 bp, Magnaporthe grisea
atgatgtcctcaaacctgctgcgcgccagggtgcccaaggccctggctgccaccaggagccatgcggccctcttctccacaacctcgcgccgcgctgagcaactgaacaagacttcggccaagatcacacagcccaagtcccagggtgcgtcacaggccatgctgtacgccaccggcttgaccgaggaggacatgaacaagccgcaggtcggcatctcgtcggtctggtacgagggcaacccctgcaacatgcacatcctcaagctgtcggagcggatccgcgactccgtcaaggccgccaacctggtccccatgcgcttcaacaccattggagtctcggacggtatcagcatgggcacgaccggcatgcgctattcgctgcagagccgtgagatcatcgccgacagtatcgagaccgtcatgcagggccagtggtacgatgccaacatctccatcccgggctgcgacaagaacatgcccggtgttctcatcgccctcggccgtgtcaaccgccccagtttgatcgtttacggcggtaccatcaagcccggctgcagccaaaagggcgagcccatcgacatcgtcagcgccttccaggcctacggccagtacctgactggtgagatcaccgaggagcagcggttcgacatcatccggaacgcgtgccccggcggtggtgcatgcggtggcatgtacactgccaacactttggcgtcggctatcgagactctgggcatgagcttgccgggaagcagcagcaaccccgcagagcaccccagcaagctggccgaatgtgaccaggttggcgaggccatcaagaacatcctccgtgaggacgtgcgcccccgcgacatcatgacgaggcaggcctttgagaacgccatggttgtagtcagcatccttggtggaagcaccaacgccgtcctgcacctgcttgccgttgccgatgcggtcggtgtcaagcttaccattgacgacttccaagccgtttccgaccggacaccgctcctggcagacctcaagccttcgggcaaatacgtcatggaggatgtacacaagattggtggcacgccatctctcctgcgcttcctggccaaggagggcttgatcgatgcttctggcatcaccgtcactggcaagaccatgaaggagaacttggacaagtaccccgacttcccggccgaccagcccatcatccggcctctcagcaaccccctcaagtccacgggccacatccagatcctccgcggtagtctcgcacccggtggctctgtcggcaagattaccggcaaggagggtcttcagttcactggcaaggcccgctgctacgactgcgaggacgactttatcgagtcgctcgagcgtggcgagatcaagaagggtgagaagacggttgtcatcatccgttacgagggccccaagggtggtcccggcatgcccgagatgctgaagcccagctcggccatcatgggtgccggtctcggcaaggacgttgccctcatcactgacggtcgcttctctggcggttcgcacggattcctcatcggacacgttgtgcccgaggccatggagggcggacctatcgcacttgttcgcgatggcgacaccattactattgatgcggagaagcgggtgatcgacacggacgtgtcggacaagaccatggcggagcgccgcgccgagtggaaggctcccccgatcagggagaccaggggaacgctggccaagtacgcagcgctggttagcgacgcgagcagtggttgcgtgacggacaaggtcgcgcgataa

SEQ ID NO: 596 - protein, 595 aa, Magnaporthe grisea
MMSSNLLRARVPKALAATRSHAALFSTTSRRAEQLNKTSAKITQPKSQGASQAMLYATGLTEEDMNKPQVGISSVWYEGNPCNMHILKLSERIRDSVKAANLVPMRFNTIGVSDGISMGTTGMRYSLQSREIIADSIETVMQGQWYDANISIPGCDKNMPGVLIALGRVNRPSLIVYGGTIKPGCSQKGEPIDIVSAFQAYGQYLTGEITEEQRFDIIRNACPGGGACGGMYTANTLASAIETLGMSLPGSSSNPAEHPSKLAECDQVGEAIKNILREDVRPRDIMTRQAFENAMVVVSILGGSTNAVLHLLAVADAVGVKLTIDDFQAVSDRTPLLADLKPSGKYVMEDVHKIGGTPSLLRFLAKEGLIDASGITVTGKTMKENLDKYPDFPADQPIIRPLSNPLKSTGHIQILRGSLAPGGSVGKITGKEGLQFTGKARCYDCEDDFIESLERGEIKKGEKTVVIIRYEGPKGGPGMPEMLKPSSAIMGAGLGKDVALITDGRFSGGSHGFLIGHVVPEAMEGGPIALVRDGDTITIDAEKRVIDTDVSDKTMAERRAEWKAPPIRETRGTLAKYAALVSDASSGCVTDKVAR

SEQ ID NO: 597 - DNA, 1797 bp, Gibberella zeae
atgctttcccggtcactgctgcgctctagagctgtgggagctttccccctctctgccaggaatcatggccgcttcctgtctaccacctccatccgctccgatgacaagctcaacaagatctcctccaacatcactcagcccaaggcccagggtgcttcccaggctatgctctacgccaccggcctctctgaagctgacatgaacaaggctcaagttggcatctcgtccgtctggtacgagggaaacccttgcaacatgcaccttatggacctctctgcccacgtcaaggagtctgtcgccaaggccggtcttattccctaccgattcaacaccatcggtgtctctgatggtatctccatgggtaccactggtatgcgatattccctccagagccgagagattattgccgatagtgttgagactgtcatgaacggtcaatggtatgacgccaacgtcagcttgcccggttgcgacaagaacatgcccggtgttgccattgccatgggtcgtgtcaaccgtcccagcatcatggtttacggtggtaccattaagcccggttgcaccaagcagggcgagtctatcgatatcgtctctgctttccaggcctacggtcaatacatcaccggcgagatcaccgaggagcagcgattcgacattatccgaaatgcctgccctggtggtggtgcttgtggtggcatgtacactgccaacaccatggctactgccattgagactctgggacttaccctccctggtagcagcagcagccctgctgaggaccccagcaagatcgccgagtgtgaggctgttggacctgctatccgcaacattctcaaggaagatatccgacctcgtgacatcatgactcgccaagcctttgagaatgccatgatcgtcactaccatccttggtggcagcaccaacgctgttctgcatcttatcgcaattgccgactctgtcggtatcaagctcgacatcgaggacttccaaaaggtttccgaccgcactcccttccttgccgacctgaagccctctggaaagtgggtcatggccgatatgcacaagattggtggtactcctgctcttctcaagttcctcttgaaggagggtatcattgacggctctggtatcactgtcactggcaagaccatgaagcagaacgtcgaggagttgcctggattccccgaggatcaaaccatcattcgcccccttagcaaccccattaagcctaccggtcacatccagattctccgtggatccctggctcctggtggctgtgttggtaagatcactggcaaggagggtctccgattcgagggtaaggcccgtgtctacgactccgagcccgccttcatctctagccttgaggctggtgagatcaagaagggtgagaagactgtcgttatcatccgatatgatggacccaagggtggccccggtatgcctgagatgctgaagccttcttctgccattatgggtgctggccttggacaggatgtcgcccttctcactgacggtcgcttctctggtggttctcacggtttcattattggtcacattgtccccgaggcaatggagggtggccctatcgcccttgtcgaggacggtgacaccatcgttatcgacgccgagtctcgtgctatcgacctcgttgttcccgaggcagaggttgatcgccgtcgcaaggcctggaaggctcccgctccccgatacaccaagggcacactcagcaagtacgctcgactggtgaccaacgccagtgagggctgtgtcaccgatagcggtctcaagaactaa

SEQ ID NO: 598 - protein, 598 aa, Gibberella zeae
MLSRSLLRSRAVGAFPLSARNHGRFLSTTSIRSDDKLNKISSNITQPKAQGASQAMLYATGLSEADMNKAQVGISSVWYEGNPCNMHLMDLSAHVKESVAKAGLIPYRFNTIGVSDGISMGTTGMRYSLQSREIIADSVETVMNGQWYDANVSLPGCDKNMPGVAIAMGRVNRPSIMVYGGTIKPGCTKQGESIDIVSAFQAYGQYITGEITEEQRFDIIRNACPGGGACGGMYTANTMATAIETLGLTLPGSSSSPAEDPSKIAECEAVGPAIRNILKEDIRPRDIMTRQAFENAMIVTTILGGSTNAVLHLIAIADSVGIKLDIEDFQKVSDRTPFLADLKPSGKWVMADMHKIGGTPALLKFLLKEGIIDGSGITVTGKTMKQNVEELPGFPEDQTIIRPLSNPIKPTGHIQILRGSLAPGGCVGKITGKEGLRFEGKARVYDSEPAFISSLEAGEIKKGEKTVVIIRYDGPKGGPGMPEMLKPSSAIMGAGLGQDVALLTDGRFSGGSHGFIIGHIVPEAMEGGPIALVEDGDTIVIDAESRAIDLVVPEAEVDRRRKAWKAPAPRYTKGTLSKYARLVTNASEGCVTDSGLKN

SEQ ID NO: 599 - DNA, 1797 bp, Aspergillus niger
atgttcgcgtcgagtatccgatcgagagctctgggattgagcccacgagcccggtttgagaatactcgtcttccatcttccactagcgggcgccgttatagatccgatgagcccctcaaccgaatttcctcgaaaatcacacaacccaaatcccagggtgcttcgcaagcaatgctctacgccaccggcctaacagaggaagacatgtccaagccacaggtcggtatctcctcggtgtggttcgagggtaacccatgcaacatgcacttgcatgacctgtctgccattgtgcgcgattccgtgctccgtgcgggtctggtccctatgcgattcaactcagttggagtgtcggatgggatcagtatgggtacaaagggaatgagatacagcctgcagagccgggagctgatcgctgatggtattgagacggtgatgaatgcccagtggtacgatgcgaatgtgtcgctcccgggttgtgataagaatatgccaggtgtattaatagcgatgggacgcacgaaccgacctagcatcatggtctacggtggcagtatcaagcctggatgcagtgcaaagggccagaaattggacctggtcagtgcattccagtcatatggccagttcatcaccggccagatcgacgagaaggagcggttcgatatcattcgcaatgcatgccccggcagaggtgcatgcggtggcatgtacacggctaatacgctggccacggctattgagactatgggaatgactattcctggtagtagtagttgcccggcagatgatcgcaagaagctagttgagtgcgaaaatattggcgaggtggttaaaaatatgctcagggaagatatcaaacccagggatatcttaacacgtcaagccttcgagaatgcaatgattgtagtgaacgtgctgggtggcagtactaatgctgttttacatctgattgccattgctgactctgtcggtatcaagttgactattgatgacttccaggcagtatctgataagacaccgttcctggctgatttgaagccatctggaaagtatcttatgaatgatctttataatatcggtggcacaccagccctcctgaaatatctcctgaaggagggcttgatcgatggctcaggagttactgttaccggtaaaacaatgaaggaaaatgtagcctcatggcctgattttcctgctgaccaggatatcatccgccccctcaacaaccctatcaaaccatctggccatctccagattcttcgcggatcgctggccccgggcggttccgtgggtaagattactggaaaggagggtctgcggtttgagggtatagctaaatgctatgattacgaagatgcattcattgagtcccttgagcggggtgagatcaagaagggcgagaaaacagtcgtgattatccggtatgaaggccccaagggtggcccaggaatgcctgagatgctcaagcccagcgcggccattatgggcgctggacttggccaggacgttgctcttcttacagatggaagattctcgggtggcagtcacggatttttgatcggacatatcgtgccggaagccatggaaggcggcccgatcgcgttggctcgagacggtgatcggatcgtgattgatgctgaggaaagagtggtcgatctggatatctctactgaggagctcgagaagaggaggaaggagtggaacgcacccccgctccggtaccagaagggaactctgaagaaatattgcacgctggtcagcgacgccagccatggttgtgtcacggacggaccgatatag

SEQ ID NO: 600 - protein, 598 aa, Aspergillus niger
MFASSIRSRALGLSPRARFENTRLPSSTSGRRYRSDEPLNRISSKITQPKSQGASQAMLYATGLTEEDMSKPQVGISSVWFEGNPCNMHLHDLSAIVRDSVLRAGLVPMRFNSVGVSDGISMGTKGMRYSLQSRELIADGIETVMNAQWYDANVSLPGCDKNMPGVLIAMGRTNRPSIMVYGGSIKPGCSAKGQKLDLVSAFQSYGQFITGQIDEKERFDIIRNACPGRGACGGMYTANTLATAIETMGMTIPGSSSCPADDRKKLVECENIGEVVKNMLREDIKPRDILTRQAFENAMIVVNVLGGSTNAVLHLIAIADSVGIKLTIDDFQAVSDKTPFLADLKPSGKYLMNDLYNIGGTPALLKYLLKEGLIDGSGVTVTGKTMKENVASWPDFPADQDIIRPLNNPIKPSGHLQILRGSLAPGGSVGKITGKEGLRFEGIAKCYDYEDAFIESLERGEIKKGEKTVVIIRYEGPKGGPGMPEMLKPSAAIMGAGLGQDVALLTDGRFSGGSHGFLIGHIVPEAMEGGPIALARDGDRIVIDAEERVVDLDISTEELEKRRKEWNAPPLRYQKGTLKKYCTLVSDASHGCVTDGPI

SEQ ID NO: 601 - DNA, 1875 bp, Neosartorya fischeri
atgttcgcgtcgagtatccgatcgagagctctgggattgagcccacgagcccggtttgagaatacgtacgagaggaccttccctcgcattgcttctctctccctcctcaaaaatcggcaaatactaataactatcgttactagtcgtcttccatcttccactaccgagcgccgttataaatccgacgagaccctcaaccgaatctcctcgaaaatcacacaacccaaatcccagggtgcctcacaagcaatgctctacgccaccggcctgacagaggaagacatgtccaagccgcaggtcggtatctcctcggtgtggttcgagggtaacccatgtaacatgcacttgcatgacctgtctgcgattgtgcgtgattccgtgcttcgggcgggtctggttcctatgcgattcaactcggttggagtgtcggatgggatcagtatgggcacaaagggaatgagatacagcctacagagtcgggagctgatcgctgatggcattgagacagtgatgaatgcccagtggtatgatgcgaatgtgtcgctcccaggttgcgataagaatatgccaggtgtgttaatggcaatgggacgcacgaatcggcctagtatcatggtctatggcggcagtatcaaacccggatgcagtgcaaagggccaaaagttagacctggtcagtgcattccagtcatatggacagttcatcaccggccagatcgatgagaaggaacggtttgatataattcgcaatgcatgccccggcagaggtgcctgcggtggcatgtacacagctaatacgctggccacagccattgagactatgggtatgaccgttcccggtagcagtagttgcccggcagacgatcctaagaagcttgttgagtgcgaaaacatcggggaggtggttaagactatgctcagggaagatatcaagcccagggatgtcttgacacgtcaagcttttgagaatgcaatgattgtggtgaacgtgctgggtggcagcactaatgctgttctacatctgattgctattgctgactctgttggtatcaagttgactattgatgacttccagacagtgtctgacaagacaccattcctagctgatttgaagccatctggaaaataccttatgaatgacctatacaacatcggtggcacaccagccctccttaaatatctcctaaaggagggcttgatcgatggctcaggaattactgtcactggcaaaacaatgaaggagaatgtagcctcatggcctgacttccctgctaaccaggatatcattcgccccctcagcaaccctattaaaccatctggtcatctccagattcttcgcggatcgctggccccgggcggttctgttgggaagattactggaaaggagggtctgcggtttgagggcacagctaagtgctatgactacgaagatgcattcattgagtcccttgagcggggcgagatcaagaagggcgacaaaacagtcgtgattattcggtatgaaggtcccaagggtggcccaggaatgcctgagatgctcaagcccagcgcggccattatgggtgctggtcttggccaggacgttgcacttctcacggacgggagattctcaggtggcagtcacggattcttgatcggacatattgtgccggaagccatggagggtggcccgatcgcgttagcacgagacggtgatcggatcgtgattgatgctgaggaaagagtggttgatctggatatcccgattgaagagctcgagaagaggaggaaggagtggaaagcacccccgctccgataccagaagggaactttgaagaagtattgcacgctggtcagcgatgccagccatggttgtgtcacagacggcccgatctag

SEQ ID NO: 602 - protein, 624 aa, Neosartorya fischeri
MFASSIRSRALGLSPRARFENTYERTFPRIASLSLLKNRQILITIVTSRLPSSTTERRYKSDETLNRISSKITQPKSQGASQAMLYATGLTEEDMSKPQVGISSVWFEGNPCNMHLHDLSAIVRDSVLRAGLVPMRFNSVGVSDGISMGTKGMRYSLQSRELIADGIETVMNAQWYDANVSLPGCDKNMPGVLMAMGRTNRPSIMVYGGSIKPGCSAKGQKLDLVSAFQSYGQFITGQIDEKERFDIIRNACPGRGACGGMYTANTLATAIETMGMTVPGSSSCPADDPKKLVECENIGEVVKTMLREDIKPRDVLTRQAFENAMIVVNVLGGSTNAVLHLIAIADSVGIKLTIDDFQTVSDKTPFLADLKPSGKYLMNDLYNIGGTPALLKYLLKEGLIDGSGITVTGKTMKENVASWPDFPANQDIIRPLSNPIKPSGHLQILRGSLAPGGSVGKITGKEGLRFEGTAKCYDYEDAFIESLERGEIKKGDKTVVIIRYEGPKGGPGMPEMLKPSAAIMGAGLGQDVALLTDGRFSGGSHGFLIGHIVPEAMEGGPIALARDGDRIVIDAEERVVDLDIPIEELEKRRKEWKAPPLRYQKGTLKKYCTLVSDASHGCVTDGPI

SEQ ID NO: 603 - DNA, 1626 bp, Neosartorya fischeri
atgctgtatgcgactggtttggaggaagcggatatgaacaaggcccaggtgggaatctcctcggtgtggtttgagggaaacccttgcaacatgcacctgatggacttgtccttggtggtacgcgactcggtcgccagggccggcctggttccaatgcgttttaactcgattggcgtttccgacggaatcagcatgggcacgagcggtatgcgatacagtctgcagagtcgtgagatcatcgcggacggcattgagacggtcatgaacgggcagtggtatgacgcgaatatctcacttccaggatgcgataagaacatgcccggtgttgttatggccatgggccgggtcaaccgtccgagcattgtgatctatggtggtagtattaagcctggttgcagcgctggtggccagactttggatctggtgagcgcctttcagtcatatggccaatacattactggtcagatagatgaagcacagcgctttgacatcattcgccatgcgtgcccgggaagtggtgcgtgtggtggcatgtatacagcgaataccatggccacagctattgaagttctcgggctcacggttccaggcagtagtagctgccccgcagaagatccgcgcaagaaagctgaatgtgaagagattggagaaacagtcaagaacctcttgaaggaagatatccggccttcggatattttgacccgccaagcatttgagaacgcaatgatcgtggtcaatattttgggaggtagcaccaatgcagtcatgcatttgattgccattgcccaatctgtgggaattaagctcaccattgatgatttccaagctgtgtctgacaagacgccatttctggccgacctaaaaccatcaggaaagtatgtcatgcatgacctgtacaagatcggcggcacaccggccctactccggttcctgctcaaggagggcttgattgacgggtctggtattactgtgaccggcaaaacaatgaaggagaatgttgcatcttggcctgatttccctgaagatcagcccattatccggccactgagcgatcccatcaagcccacgggtcaccttcaaattctgcgaggatccttggcacctggaggctccgttggtaagatcaccggtaaagagggtctccgatttgaaggcagtgccaagtgctacgactatgaagatgcctttgtggatgctcttgaaaagggagaaattaagaagggtgaaaagacagttgttattatccgatacgaggggccaaagggtggtccaggtatgccggaaatgctcaagcctagtgccgccatcatgggtgccggactgggtcaggatgtcgccctccttaccgacggtcgattttctggtggcagtcatggattcctaatcggtcatattgttcctgaggcaatggatggtggtccaatcgccctggtcaaagatggggacagggtgattatcgacgcagagaagagggtggttgatctggatatatccggagaagagatgcagaggaggaagaaggcatggaaagcgcctgaacctcgggcaaagaaaggcactctaaagaagtatgcagctcttgtcagtgacgctagccatggctgtgtcactgatgggccactttga

SEQ ID NO: 604 - protein, 541 aa, Neosartorya fischeri
MLYATGLEEADMNKAQVGISSVWFEGNPCNMHLMDLSLVVRDSVARAGLVPMRFNSIGVSDGISMGTSGMRYSLQSREIIADGIETVMNGQWYDANISLPGCDKNMPGVVMAMGRVNRPSIVIYGGSIKPGCSAGGQTLDLVSAFQSYGQYITGQIDEAQRFDIIRHACPGSGACGGMYTANTMATAIEVLGLTVPGSSSCPAEDPRKKAECEEIGETVKNLLKEDIRPSDILTRQAFENAMIVVNILGGSTNAVMHLIAIAQSVGIKLTIDDFQAVSDKTPFLADLKPSGKYVMHDLYKIGGTPALLRFLLKEGLIDGSGITVTGKTMKENVASWPDFPEDQPIIRPLSDPIKPTGHLQILRGSLAPGGSVGKITGKEGLRFEGSAKCYDYEDAFVDALEKGEIKKGEKTVVIIRYEGPKGGPGMPEMLKPSAAIMGAGLGQDVALLTDGRFSGGSHGFLIGHIVPEAMDGGPIALVKDGDRVIIDAEKRVVDLDISGEEMQRRKKAWKAPEPRAKKGTLKKYAALVSDASHGCVTDGPL

SEQ ID NO: 605 - DNA, 1845 bp, Aspergillus niger
atgccttttctgcggtggcctccaggccagaaaatcatgatcacacctaccactcctttccgagctgccagaactctggcattcggtggacggatactatcgcccaaaaagtcatcctctcgtcttctctcctcaactgcacatagttatgccgacgaaacactgaacaaagtctcctctaagatcacacaacccaagtcccagggtgcatctcaagcgatgctttacgcgaccggcttgacggagaaagacatgtccaaggcacaggttggaatttcatcagtgtggttcgaagggaatccttgtaacatgcacttgatggatttgtcgtcgctggttcgcgagtcggtagccaaagctggcctggttcccatgcgtttcaactccatcggcgcctctgatggcattagtatgggcacatctggcatgcgattcagtttacagagccgagagatcattgctgatggaattgaaacggtcatgaatgcccagtggtatgatgctaatatctcgttgcctggctgtgataagaacatgccaggtgtgctgatggctatgggtcgggtcaaccgtccgagtatcatggtgtatggtggtagtatcaagcccggctgcagtgcggggggtaagccacttgacttggtcagcgcctttcaatcgtatggccaatatctcactggtgagatcgacgagaaggaacgatttgatattatccgacacgcttgcccaggtgctggtgcctgtgggggtatgtatacggctaatacactggcaacggccatcgagaccctcggaatgacggtccctggaagcagcagtacaccggcagaggatccgaggaagctggcagagtgtgaggacatcggtcagacggtgaagaatctgctgaaggaggacatccgtcccaaggatatcatgacacggcaggcatttgaaaatgctatgattgttgtgaatattcttggaggcagcaccaatgcagtgctgcacttgattgctatcgctaattccgttgggatcaaattgactatcgatgacttccaggctgtgtcagacaagacacctttcttagctgatctaaagccttccggcaagtatgtcatgcatgacctgtacaaagtcgggggcacgcctgcactgctgaagttcctgctcagggaaggccttattgacggctccggcgtcactgttactggcaaaaccatgaaagagaatgtagcctcatggcccgaattttcacctgagcagcccatcatccgccctctaagcaatcccatcaagccaaccggccacttgcagatccttcgtgggtcattggcccccggcggctcggttggaaaaatcaccggcaaagaaggtctacggttcgaaggtcttgctaaatgttacgactttgaggacgctttcattgaggctctcgaacgaggcgagatcaagaagggcgagaaaacggtcgttattattcgatatgaagggcccaaaggcggccccgggatgcctgagatgctcaagcccagctcagctatcatgggcgcgggattgggtcaggatgttgcgctactcactgatggaagattctctggaggtagtcatggctttttaattgggcatgttgtgcctgaggctatggagggtgggcccattgccctggtgaaggatggcgatcggatcgtaattgatgcggagcaaagagtggttgacctgctgatcaccccagaagaaatggcaaagagaagagtgtcttggacagcaccggcacctcgggcgaagaaggggacattaagcaagtatgcgaagctggtgagcgatgcgagccatgggtgcgtgacggatggtccaatatag

SEQ ID NO: 606 - protein, 613 aa, Aspergillus niger
MPFLRWPPGQKIMITPTTPFRAARTLAFGGRILSPKKSSSRLLSSTAHSYADETLNKVSSKITQPKSQGASQAMLYATGLTEKDMSKAQVGISSVWFEGNPCNMHLMDLSSLVRESVAKAGLVPMRFNSIGASDGISMGTSGMRFSLQSREIIADGIETVMNAQWYDANISLPGCDKNMPGVLMAMGRVNRPSIMVYGGSIKPGCSAGGKPLDLVSAFQSYGQYLTGEIDEKERFDIIRHACPGAGACGGMYTANTLATAIETLGMTVPGSSSTPAEDPRKLAECEDIGQTVKNLLKEDIRPKDIMTRQAFENAMIVVNILGGSTNAVLHLIAIANSVGIKLTIDDFQAVSDKTPFLADLKPSGKYVMHDLYKVGGTPALLKFLLREGLIDGSGVTVTGKTMKENVASWPEFSPEQPIIRPLSNPIKPTGHLQILRGSLAPGGSVGKITGKEGLRFEGLAKCYDFEDAFIEALERGEIKKGEKTVVIIRYEGPKGGPGMPEMLKPSSAIMGAGLGQDVALLTDGRFSGGSHGFLIGHVVPEAMEGGPIALVKDGDRIVIDAEQRVVDLLITPEEMAKRRVSWTAPAPRAKKGTLSKYAKLVSDASHGCVTDGP

SEQ ID NO: 607 - DNA, 1848 bp, Aspergillus niger
atgcttctttcccaaacccgggggcgtatgccctccgctctccggagcatcgccaagcgctctttgctgaacagtcgccctctgtctaccactctgcccaagcaacagaacggcaacgatgacgagtatactggtctcaacaaggtctcccgccacattacccagcccatctcccagggtgcttcccaggccatgctgtatgccgcaggcctcactgaggcggacatgaacaaggctcaggtcggcatttcttctgtctggtacaatggcaacccctgcaacatgcatctgctcgatcttaacaaccgtgtccgcgagggtgtccagaaggccggtttggtcggtttccagttcaacaccgtcggtgttagcgatgctatcagtatgggtaccaagggaatgcgattctctctccagagtcgtgatctgattgccgactctatcgagaccgttatgggtggtcaatggtatgacgctaacatcagcattcccggctgtgacaagaacatgcctggtgtgttgatggcaatgggacgagtgaaccgccccagtttgatggtctacggtggaaccatcaagcctggttgcgcctccatgcagggcaacgccgacattgatatcgtctccgccttccaggcctatggtcagttcatcagtaaggaaatcaccgagccccagagatttgacattatccgcaacgcctgccctggaggtggtgcttgcggtggtatgtacactgccaataccatggccactgctatcgaagtcatgggcatgacccttcctggatcctcttccaaccccgccgagtctgacgctaagtaccttgaatgtcttgcggctggtgaggccatcaagaccctgctcaaggaggacattcgtccttcggacatcctgactcgccaagctttcgagaacgccatggtcttggtcaacatcactggtggctccaccaacgccgttcttcacttgattgccattgcggactctgttggtatcaagctcgacattgaagacttccagtccgtctcggatcgcattcctttcctggcggaccttaagccttccggcaagtacgtcatggctgaccttcacaagatcggtggtaccccctccctgctcaagttcttgctgaaggaaggtctcatcgatggctctggcatgactgtcactggtcagaccctggccaagaacttggagaatgtgccggacttccctgaggatcagaagatcatccgtcccctgtccaaccccatcaaggagactggccacatccagatcttgaggggttctctggccccgggtggcagtgtcggcaagatcactggtaaggaaggaaccgtcttcactggaaaggctcgcgtctttgacgacgaggatgatttcattgctgctctcgagcgcaacgagatcaagaaggaggagaagactgttgttgtcatccgctacactggtcctaagggaggacctggcatgcccgaaatgctgaagccctcttccgccctgatgggtgccggtctcggacagtcctgcgctctgatcaccgatggccgtttctctggtggttctcacggtttcttgatcggacacattgttcccgaagccgccgtcggtggccccattggcttggttaaggatggtgatgtcatcaccattgacgccgagaagcgtgttctggaccttgatgttgaggagaccgagctcgcgcaaagaagaaagcagtgggaagccgacagggctgctggcaagctccctcccaccggcctgaccctgagaggtactctcggcaagtacgctagaaccgtcaaggatgccagccacggctgtatcaccgactctctcgaataa

SEQ ID NO: 608 - protein, 615 aa, Aspergillus niger
MLLSQTRGRMPSALRSIAKRSLLNSRPLSTTLPKQQNGNDDEYTGLNKVSRHITQPISQGASQAMLYAAGLTEADMNKAQVGISSVWYNGNPCNMHLLDLNNRVREGVQKAGLVGFQFNTVGVSDAISMGTKGMRFSLQSRDLIADSIETVMGGQWYDANISIPGCDKNMPGVLMAMGRVNRPSLMVYGGTIKPGCASMQGNADIDIVSAFQAYGQFISKEITEPQRFDIIRNACPGGGACGGMYTANTMATAIEVMGMTLPGSSSNPAESDAKYLECLAAGEAIKTLLKEDIRPSDILTRQAFENAMVLVNITGGSTNAVLHLIAIADSVGIKLDIEDFQSVSDRIPFLADLKPSGKYVMADLHKIGGTPSLLKFLLKEGLIDGSGMTVTGQTLAKNLENVPDFPEDQKIIRPLSNPIKETGHIQILRGSLAPGGSVGKITGKEGTVFTGKARVFDDEDDFIAALERNEIKKEEKTVVVIRYTGPKGGPGMPEMLKPSSALMGAGLGQSCALITDGRFSGGSHGFLIGHIVPEAAVGGPIGLVKDGDVITIDAEKRVLDLDVEETELAQRRKQWEADRAAGKLPPTGLTLRGTLGKYARTVKDASHGCITDSLE

SEQ ID NO: 609 - DNA, 1833 bp, Aspergillus terreus
atgcttctctctcagacccggggccgtctgccctccctgcggaccctcaagcggtccatggcggtccgtccgctctctaccaccctccccaagcacaaggccgatgagaaagagcctgtcctcaacaaagtctcccgccatgtcacccaacccatctcccagggtgcgtcccaggccatgctctacgccaccggtctcaccgaggccgacatgaacaaggcccaggtcggtatctcctccgtctggtacaatggcaacccctgcaacatgcacctcctcgacctcaacaaccgtgtgcgggagggtgtccagaaggctggcctggtcgggttccagttcaacaccgtcggagtcagcgacgcgatcagcatgggtacctccggtatgcgcttctcgctgcagagccgtgatctcattgccgactccattgagactgtcatgggtggtcagtggtacgacgccaacatcagtatccctggttgcgacaagaacatgcccggtgtcctgatggccatgggcagagtcaaccgtcccagtctgatggtttacggtggttccattaagcccggctgcgcttcgatgcagaacaacgccgatatcgatatcgtctccgccttccaggcgtacggtcagttcatcagcggagagatcaccgagccccagcgtttcgacatcatccgcaacgcctgccccggaggtggcgcgtgcggtggtatgtacaccgccaacaccatggccaccgccatcgaggtcatgggtatgacccttcctggttcctcctccaaccccgccgagtcggcggccaagaacatcgagtgtctggcggccggtgaggccatcaagaagcttctggtggaagacatccgtccctccgatatcctgactcgccaggccttcgagaatgccatgattgttgtgaacattaccggtggttcgaccaatgcggtgctgcaccttatcgccattgccgattcggtcggcatcaagctagatattgaggacttccagaaggtctcggaccgtgtgccgttcctggctgacctcaagccttccggcaagtacgtcatggcggacctgcacaagatcggtggtactccttctctgctcaagttcctgcttaaggagggcctgatcgatggctctggtatgaccgtcaccggtcagaccctggccaagaacctggagaacgtgccggacttccccgaggaccagaagatcatccgtcctctgtctaaccccatcaaggagaccggtcacatccagattctccgtggctctctggcccctggcggtagtgtcggtaagatcactggtaaggagggtaccgttttcaccggtaaggctcgcgtcttcgaccacgaggacgacttcatcgctgcgctcgagcgcaaggagatcaagaaggaggagaagacggtcgttgtcatccgttatactggacccaagggtggtccgggtatgcctgaaatgctgaagccttcttctgccctcatgggcgccggtctgggcggctcctgcgctctgatcaccgacggacgtttctccggcggctctcacggattcctgatcggacatatcgtccccgaggctgctgtcggtggaccgattggtctggttaaggacggcgatgtgatcaccatcgacgccgtcaagcgtgtgctggatctggacgttgacgagaccactctggccgagagaagaaagcagtgggaggccgacaaggaggctggccgtctccctcctaccggtctgactctgcgtggtaccctgggcaagtatgctagaaatgtcaaggatgccagccacggctgcatcaccgatgctcttgactaa

SEQ ID NO: 610 - protein, 610 aa, Aspergillus terreus
MLLSQTRGRLPSLRTLKRSMAVRPLSTTLPKHKADEKEPVLNKVSRHVTQPISQGASQAMLYATGLTEADMNKAQVGISSVWYNGNPCNMHLLDLNNRVREGVQKAGLVGFQFNTVGVSDAISMGTSGMRFSLQSRDLIADSIETVMGGQWYDANISIPGCDKNMPGVLMAMGRVNRPSLMVYGGSIKPGCASMQNNADIDIVSAFQAYGQFISGEITEPQRFDIIRNACPGGGACGGMYTANTMATAIEVMGMTLPGSSSNPAESAAKNIECLAAGEAIKKLLVEDIRPSDILTRQAFENAMIVVNITGGSTNAVLHLIAIADSVGIKLDIEDFQKVSDRVPFLADLKPSGKYVMADLHKIGGTPSLLKFLLKEGLIDGSGMTVTGQTLAKNLENVPDFPEDQKIIRPLSNPIKETGHIQILRGSLAPGGSVGKITGKEGTVFTGKARVFDHEDDFIAALERKEIKKEEKTVVVIRYTGPKGGPGMPEMLKPSSALMGAGLGGSCALITDGRFSGGSHGFLIGHIVPEAAVGGPIGLVKDGDVITIDAVKRVLDLDVDETTLAERRKQWEADKEAGRLPPTGLTLRGTLGKYARNVKDASHGCITDALD

SEQ ID NO: 611 - DNA, 1824 bp, Aspergillus clavatus
atgcttctctctcagacccggggccgtgtgccctctgttctccggagcttctcccgccgctccctctctaccaccatccccagatacaccgccgataaggatgactctgctctcaacaaggtgtcccgcaatgtcacacagcccatctcgcagggtgcctcccaggccatgctgtacgccacgggtcttaccgaggcggacatgaacaaggctcaggtcggtatctcgtcggtctggtacaatggcaacccctgcaacatgcatctgctcgatctcagcaaccgcgttcgcgaaggagtccagaaggctggtctggttggcttccagttcaacacggtcggtgtcagtgatgccatcagcatgggcaccaagggcatgcgcttctccctgcagagccgtgacctgattgccgactccatcgagaccgtcatgggtggtcagtggtacgacgccaacatcagtatccccggttgcgacaagaacatgcccggtgtgctcatggccatgggccgtgtcaaccgccccagtttgatggtgtatggtggtaccatcaagcccggctgcgccaaaacccagaacaacgccgacatcgacattgtctcggccttccaggcgtacggacagttcctgactggcgagatcaccgagccccagcgcttcgacatcatccgtaacgcctgccccggcggtggtgcttgcggtggtatgtacactgccaacaccatggccaccgccatcgaggtcatgggtatgaccctgcctggctcgtcgtccaaccccgctgagtctaaggccaaggaccttgagtgcttggctgctggtgaggccatcaagcgcctgctgaaggaggatatccgtccctcagacatcctgacccgccaggccttcgagaacgccatgattgtggtcaacatcaccggtggctccaccaacgccgtacttcacttgatcgccattgccgactccgtcggcatcaagctggacatcgaggagttccagaaggtctcggaccgcacccccttcctggcggacctcaagccctccggcaagtacgtcatggccgatctgtacgacatcggcggaactcctgctctgctcaagttcctgctcaaggagggcgtcatcgacggctccggcatgaccgtcaccggtgagaccctggccaagaacttggagaaggtgcccggcttccccgaggaccagaagatcatccgtcctttttcgaaccccatcaagaagactggccacattcagatcctgcgcggctccctggcccccggcggcagtgttggcaagatcaccggtaaggagggtacccgcttcgttggcaaggcccgcgtcttcgaccacgaggacgacttcattgccgctctcgagcgcaacgaaatcaagaaggaggacaagaccgttgtcgtcatccgctacaccggccctaagggtgggcccggcatgcctgaaatgctcaagccctcctccgccctgatgggcgccggcctcggctcctcctgcgcactcatcaccgacggtcgtttctccggcggctcccacggcttcctgattggccacatcgtccccgaggccgccgtcggcggccccatcggcctcgtccaggacggcgacatcatcaccatcgacgccgagaagcgcatcctcgacctcgacgtccccgagcccgagctcgcccagcgcagaaaggattgggaggccgccaaggccgccggcaagttgccccagaccggtctcaccatgagaggtaccctgggcaaatatgccagaaccgtcaaggatgccagccacggctgcattactgattatatagaataa

SEQ ID NO: 612 - protein, 607 aa, Aspergillus clavatus
MLLSQTRGRVPSVLRSFSRRSLSTTIPRYTADKDDSALNKVSRNVTQPISQGASQAMLYATGLTEADMNKAQVGISSVWYNGNPCNMHLLDLSNRVREGVQKAGLVGFQFNTVGVSDAISMGTKGMRFSLQSRDLIADSIETVMGGQWYDANISIPGCDKNMPGVLMAMGRVNRPSLMVYGGTIKPGCAKTQNNADIDIVSAFQAYGQFLTGEITEPQRFDIIRNACPGGGACGGMYTANTMATAIEVMGMTLPGSSSNPAESKAKDLECLAAGEAIKRLLKEDIRPSDILTRQAFENAMIVVNITGGSTNAVLHLIAIADSVGIKLDIEEFQKVSDRTPFLADLKPSGKYVMADLYDIGGTPALLKFLLKEGVIDGSGMTVTGETLAKNLEKVPGFPEDQKIIRPFSNPIKKTGHIQILRGSLAPGGSVGKITGKEGTRFVGKARVFDHEDDFIAALERNEIKKEDKTVVVIRYTGPKGGPGMPEMLKPSSALMGAGLGSSCALITDGRFSGGSHGFLIGHIVPEAAVGGPIGLVQDGDIITIDAEKRILDLDVPEPELAQRRKDWEAAKAAGKLPQTGLTMRGTLGKYARTVKDASHGCITDYIE

SEQ ID NO: 613 - DNA, 1842 bp, Aspergillus nidulans
atgcttctttcacagactcggggccgcctgccctctgctctccgcagcttggccaacagagctgctattcgtccaatctctactacactcccccgccaaaaagcgtcgccaaaagatgatgagcccgtcctcaacaaggtctcccgccatatcacacagccggtgtcccagggtgcttcccaggcgatgctgtacgctacgggtcttactgaggccgacatgaacaaggcccaggttggtatttcctcggtctggtacaacggcaacccttgcaacatgcacctcctcgacctgaacaaccgtgtccgcgagggtgtgcaaaaggctggccttatcgggtaccagttcaacaccattggtgtcagtgatggaatcagtatgggtaccagtggtatgcgttactcgcttcagagccgtgacctcatcgccgactctatcgagaccgtcatgggtggtcagtggtacgacgccaacatcagcatccccggttgcgacaagaacatgcccggtgttttgatggctatgggacgagtcaaccgccccagtttgatggtttacggtggaaccatcaagcccggctgcgcatccatgcagggcaacgctgacatcgatatcgtctctgccttccaagcctacggccagttcatcagcggtgagatcaacgagccccagcgcttcgatatcatccgccacgcctgccccggtggcggcgcttgcggtggaatgtacactgccaacaccatggccacggccatcgaagtcatgggtatgaccctcacgggctcctcgtccaacccggccgaatcgcaagccaaatacgacgaatgtcttcgcgctggtgaagccatcaagcgcctcctcgtcgaagacatccgcccctccgacatcatgactcggcaagccttcgagaacgccatggtcgttgtcaacatcaccggcggctccaccaatgctgtccttcacctcatcgccattgccgactccgtcggcatcaagctcacaattgacgacttccaagccgtctctgaccgcacccccttcctcgcagacctcaagccatccggcaaatacgttatggccgacctccacaacatcggcggcaccccctccctcctcaaattcctcctcaaggaaggcgtcattgatggctccggcatcacagttaccggtgaaactctcgccaagaacctcgagaaagtccccgatttccccgaggaccagaaaatcattcgccccttctccaaccccatcaaggaaacaggccacatccagatcctgcgcggttcgctcgcgccgggcggttgcgttggtaagattaccggtaaggagggaaccgttttcacgggcaaggcccgcgtctttaaccacgaagacgacttcattgccgccctggagcgcaaggaaatcaccaaggatgagcaaactgtcgttgtgattcgctacaccggtcccaagggtggtcccggtatgcctgaaatgctcaagccttcaagcgccctcatgggtgctggcctcggccaaacctgcgccctgatcacagacggacgcttctccggtggttcgcacggcttccttattggacacatcgtcccagaggctgccgtcggtgggccgattggtctcgtacacgacggcgacgtgatcaccattgatgccgagaagcgcgttttggaccttgacgttgacgaggcggaactcgctaagcgacggaagcagtgggaggctgataaggcggcgggcaagttgccccagaccgggttgaacttgcgcgggacgcttggaaagtatgcccggaatgtcaaggatgctagttccgggtgtattacggacgctttcgattaa

SEQ ID NO: 614 - protein, 613 aa, Aspergillus nidulans
MLLSQTRGRLPSALRSLANRAAIRPISTTLPRQKASPKDDEPVLNKVSRHITQPVSQGASQAMLYATGLTEADMNKAQVGISSVWYNGNPCNMHLLDLNNRVREGVQKAGLIGYQFNTIGVSDGISMGTSGMRYSLQSRDLIADSIETVMGGQWYDANISIPGCDKNMPGVLMAMGRVNRPSLMVYGGTIKPGCASMQGNADIDIVSAFQAYGQFISGEINEPQRFDIIRHACPGGGACGGMYTANTMATAIEVMGMTLTGSSSNPAESQAKYDECLRAGEAIKRLLVEDIRPSDIMTRQAFENAMVVVNITGGSTNAVLHLIAIADSVGIKLTIDDFQAVSDRTPFLADLKPSGKYVMADLHNIGGTPSLLKFLLKEGVIDGSGITVTGETLAKNLEKVPDFPEDQKIIRPFSNPIKETGHIQILRGSLAPGGCVGKITGKEGTVFTGKARVFNHEDDFIAALERKEITKDEQTVVVIRYTGPKGGPGMPEMLKPSSALMGAGLGQTCALITDGRFSGGSHGFLIGHIVPEAAVGGPIGLVHDGDVITIDAEKRVLDLDVDEAELAKRRKQWEADKAAGKLPQTGLNLRGTLGKYARNVKDASSGCITDAFD

SEQ ID NO: 615 - DNA, 1848 bp, Aspergillus oryzae
atgcttctttcacaaacccgggggcgtatgccctctgctctgcggagcctctccaggcggtccgccgtcaatgttcgtcccctctctaccaccctccccaagcaaaaggcctcttcctccgaagacgacaacgctctgaacaaggtctcccgccatgtcacacagcccatctcgcagggtgcttcccaggccatgctttacgctaccggtctcaccgaggaggacatgaacaaagctcaagtcggtatctcctccgtttggtatagcggtaacccctgtaacatgcatctgctcgatctcaaccaccgcgtcaagcaaggtgtggaacaggcaggcttgatcggcatgcagttcaacaccgtcggtgtcagtgatgcaatcagtatgggtacgaagggtatgcgatattctcttcagagtcgtgatctgattgccgactctatcgagactgttatgggtggtcagtggtacgatgccaacatcagtatcccgggttgcgacaaaaacatgcccggtgtgttgatggccatgggcagagtcaaccggccgagcattatgttgtacggaggcaccatcaagcccggttgtgccgctacccaaaacaatgccgagattgacatcgtctccgcattccaggcctacgggcagttcctgagcggcgacattaccgagcctcagcgatttgatattatccgtaacgcttgcccaggaggcggtgcctgcggtggtatgtacacggccaacaccatggccaccgccattgagaccattggtatgaccctccctggctcttcttccaaccccgccgagtcccgcgccaaggaccttgagtgtctggctgttggtggggcgatcaagaagcttctgaaggaggacatccgccctagggatattatgacccgccaagctttcgaaaacgccatggttgtggtgaacatcaccggtggctcgaccaacgctgtgctgcacttgattgccatcgctgattcggtcggcatcaagctggatattgaggacttccagtccgtctccgaccgtattcctttcttggctgatctgaagccatcgggcaagtacgtcatggccgacatgcacaagatcggaggtacccccgcactgctcaagttcctgctcaaggaaggcctcatcgatggttccggcatgactgtcaccggtgagactctagccaagaacctcgagaaggttcccgatttccccgaagatcagaagatcatccgccctctgtccaaccccatcaaggagactggccatatccagattctgaagggatccctggctccgggtggcagtgttggtaagatcactggcaaggagggtacttctttcactggtaaggcacgtgtcttcgatgatgaggatgatttcatcgctgctctggagcgtggtgagatcaaaaaggaggacaagactgttgtggttatccgctacaccgggcccaaggggggtcctggtatgcccgaaatgttgaagccctcttctgcccttatgggctatggtctcggacagtcggttgccctcatcaccgatggacgtttctccggcggctctcatggcttcctgatcggacacattgtccctgaggctgctgttggtggacctattggtctcgtcaaggatggtgatgtcatcgtcattgatgctgagaagcgcgttctcgaccttgaggttgaccaggagactctcgccgagagacgcaagcagtgggaagccgataaggaggccggcaagctgcctcccaccggtctgactatgagaggaaccctcggcaagtacgctaggaccgtcaaggatgccagccacggctgtatcaccgatgctcttgattaa

SEQ ID NO: 616 - protein, 615 aa, Aspergillus oryzae
MLLSQTRGRMPSALRSLSRRSAVNVRPLSTTLPKQKASSSEDDNALNKVSRHVTQPISQGASQAMLYATGLTEEDMNKAQVGISSVWYSGNPCNMHLLDLNHRVKQGVEQAGLIGMQFNTVGVSDAISMGTKGMRYSLQSRDLIADSIETVMGGQWYDANISIPGCDKNMPGVLMAMGRVNRPSIMLYGGTIKPGCAATQNNAEIDIVSAFQAYGQFLSGDITEPQRFDIIRNACPGGGACGGMYTANTMATAIETIGMTLPGSSSNPAESRAKDLECLAVGGAIKKLLKEDIRPRDIMTRQAFENAMVVVNITGGSTNAVLHLIAIADSVGIKLDIEDFQSVSDRIPFLADLKPSGKYVMADMHKIGGTPALLKFLLKEGLIDGSGMTVTGETLAKNLEKVPDFPEDQKIIRPLSNPIKETGHIQILKGSLAPGGSVGKITGKEGTSFTGKARVFDDEDDFIAALERGEIKKEDKTVVVIRYTGPKGGPGMPEMLKPSSALMGYGLGQSVALITDGRFSGGSHGFLIGHIVPEAAVGGPIGLVKDGDVIVIDAEKRVLDLEVDQETLAERRKQWEADKEAGKLPPTGLTMRGTLGKYARTVKDASHGCITDALD

SEQ ID NO: 617 - DNA, 1836 bp, Ajellomyces capsulatus
atgctccgattacaagcacggggccggatgcccaactgcttcaaaagactgcttttcccattgtcctgtcgagctctctccgcaactccatacccatattcatcttcgtcctcacaggagaagaagctcaacagtgtttcccaacatgtaacgcaacccatttcccaaggtgcctcacaggccatgctttacgctacgggcctaatgccggaggatatgtcgaaagctcaagttggcatctctagcgtctggtacaacggaaacccctgcaacatgcatctcctcgatctcagcaaccgtgtgcgcgaaggtgtgcaaaaggcgggactcataggttaccagttcaacactgttggcgtcagtgacgctatcagcatgggtacgtcaggtatgcggtacagtttgcagagtcgggatctcatcgcggactcgattgagacggtcatgggtggtcaatggtatgatgctaacatcagcatccccgggtgtgacaagaatatgcctggcgtggttatggcaatgggaagagtaaaccggccaagtttgatggtttatggcggaacaattaagcccgggtgcgcggtaacccaaaacaacgccgatatcgacatcgtgtctgcgttccaggcttacggccaattcataactggtgagatcactgaggctcagcgatacgacatcatccgacatgcttgccctggcggtggtgcttgtggggggatgtacactgcaaacaccatggcgtctgcgatcgaagttatgggaatgacgttaccgggatcttcatcgaaccctgcagaatccaaagccaaggatctagaatgcctgacggctggggaagcaattaaaacccttctcaaggaggatatccgtcccactgacatcttgacgcgccaggcctttgaaaatgcaatggttcttgtcaacatcaccggcggctccaccaacgcagtgctccatctgatcgctatagctgactctgtcggaattaaactcacaattgacgatttccagtcagtcagtgaccgcatccccttcctcgcagatctcaagccttccggtaaatatgttatggccgatcttcatacaattggtggtactccctcattactcaagttcctcttgaaggagggtctcatcgacggctctggaattaccgtgactggtcaaaccctggccaagaacctcgagaaggttcctgaattcccttcagatcagaaaatcattcgacccctcaacaaccccatcaagaaaactgggcacatccagatcctccgcggaagcctcgcccctgaaggcagcgtcggcaaaattacaggaaaggagggtaccaagttcactggcaaggcgaaggtctacgatcatgaagacgattttattaccgcattagaacagaatgagatttcgaaggacgagaagacagtcgtggtaattcgttacactgggcccaagggtggtccgggaatgcctgaaatgctcaagccttcctccgcccttatgggcgcggggctaggttcatccgtcgccttgatcacagacggccgtttcagtggtggctctcatggcttcctgatcggccacatcgttcccgaagccgcagtcgggggccctattgcgctcgtccacgatggcgatgtcatcaccattgacgccgaaaaacgtttgctcgaccttgacgtctccgaacacatcctagctcagcgtaggaaggaatgggccgatagggagagtaaaggactaaatcccgttacgggaatgaaaatgagagggacgctgggaaaatatgctagatctgtcaaggacgcaagtcacggatgcatcaccgacgcattatag

SEQ ID NO: 618 - protein, 611 aa, Ajellomyces capsulatus
MLRLQARGRMPNCFKRLLFPLSCRALSATPYPYSSSSSQEKKLNSVSQHVTQPISQGASQAMLYATGLMPEDMSKAQVGISSVWYNGNPCNMHLLDLSNRVREGVQKAGLIGYQFNTVGVSDAISMGTSGMRYSLQSRDLIADSIETVMGGQWYDANISIPGCDKNMPGVVMAMGRVNRPSLMVYGGTIKPGCAVTQNNADIDIVSAFQAYGQFITGEITEAQRYDIIRHACPGGGACGGMYTANTMASAIEVMGMTLPGSSSNPAESKAKDLECLTAGEAIKTLLKEDIRPTDILTRQAFENAMVLVNITGGSTNAVLHLIAIADSVGIKLTIDDFQSVSDRIPFLADLKPSGKYVMADLHTIGGTPSLLKFLLKEGLIDGSGITVTGQTLAKNLEKVPEFPSDQKIIRPLNNPIKKTGHIQILRGSLAPEGSVGKITGKEGTKFTGKAKVYDHEDDFITALEQNEISKDEKTVVVIRYTGPKGGPGMPEMLKPSSALMGAGLGSSVALITDGRFSGGSHGFLIGHIVPEAAVGGPIALVHDGDVITIDAEKRLLDLDVSEHILAQRRKEWADRESKGLNPVTGMKMRGTLGKYARSVKDASHGCITDAL

SEQ ID NO: 619 - DNA, 1845 bp, Coccidioides immitis
atgcttcagctaaggcctcgcgggcatatgccctacaggcaattgctcacttatctctctcaccgtgccttttcttccagatcgacgttccagcagaagtcttcgtcgaatcccccgtcaaaatcaggaaagccattaaatgaagtatccagccatatcacgcagccaatctcccagggcgcttcccaggctatgctttacgctaccgggctttcgacggacgacatgtccaagcctcaggtcgggatctccagtgtctggtacaatgggaatccctgcaacatgcacctcctggacctaagcaacatcgtgcgggaaggcgtgcaaaaggcaggattgatcggatatcaattcaacaccattggtgttagtgacggaattagcatgggaacaaaaggaatgagatacagcttgcagagcagagacctaatcgccgattccatagagaccgtcatgggtggtcagtggtacgacgcaaatatcagtctgccgggatgcgataaaaacatgccgggagttatcatggctatgggtcgtgtgaaccggccgagtttgatggtatatgggggaacgatcaggccgggctgtgctgcaacacaaaacaatgctgatatcgatatcgtgtccgccttccaggcatacggccaattcttgactggggagatctccgaggagcagcgatttgatattatccgccatgcctgccctggtggtggtgcatgtggtggaatgtacaccgcaaacaccatggcttcggctatcgaggtcatgggaatgacccttccgggctcttcctccaacccagcagaatctaaggcaaagaaggccgaatgtctggctgcgggcgaagccatcaagaaccttctcatcgaggatattcgaccatccgacatcctcaccaggaccgcatttgaaaacgccatgatcttggtgaacatcactggaggctccaccaacgcggtcctccacctcattgccatggccgactccgtcggcatcaaactcaccattgatgacttccaggccgtcagcgatcgtaccccgttcctcgcagaccttaagccatccggaaagtacgtcatggctgatctgcacaacattggcggcaccccatccctgattaaattcctactgaaggagggtgtcctcgacggttcgggaatgactgttaccggtcagaccttggccaagaacgtagagaatgtccctgacttcccatctgaccaaaagatcatccgacctttcagcaacccaatcaagaagaccggccatcttcaaatcctccgtggcagcctcgctcctgaggggagtgtaggcaagatcacaggcaaagaaggaacaagtttcacaggcaaagctagagtgtatgacgatgaagatgattttattgcctctttggaacgaaacgaaattaaaaaggaagagaaaactgtcgttgttatccgatatactggaccgaagggaggaccaggaatgccagagatgcttaagccttcttctgccctgatgggtgccggattgggctcttctgttgccctcatcacggacgggcgtttcagtggtggttctcatggcttcttgatcggacacatcgtccctgaagccgcggttggcggaccaatcgccctcgttgaagacggcgacatcatcaccatcgacgccgagaagcgagttctcgatcttgaagtcggtgaagacgttctcgcgcaaagaaggaagaagtggcaggagaaacaggaggcaggcctcggtcgtccaactggattgacgatgaggggaactctgggtaaatatgccagagctgtgacggatgctagtcatggatgtatcaccgacggtgtatga

SEQ ID NO: 620 - protein, 614 aa, Coccidioides immitis
MLQLRPRGHMPYRQLLTYLSHRAFSSRSTFQQKSSSNPPSKSGKPLNEVSSHITQPISQGASQAMLYATGLSTDDMSKPQVGISSVWYNGNPCNMHLLDLSNIVREGVQKAGLIGYQFNTIGVSDGISMGTKGMRYSLQSRDLIADSIETVMGGQWYDANISLPGCDKNMPGVIMAMGRVNRPSLMVYGGTIRPGCAATQNNADIDIVSAFQAYGQFLTGEISEEQRFDIIRHACPGGGACGGMYTANTMASAIEVMGMTLPGSSSNPAESKAKKAECLAAGEAIKNLLIEDIRPSDILTRTAFENAMILVNITGGSTNAVLHLIAMADSVGIKLTIDDFQAVSDRTPFLADLKPSGKYVMADLHNIGGTPSLIKFLLKEGVLDGSGMTVTGQTLAKNVENVPDFPSDQKIIRPFSNPIKKTGHLQILRGSLAPEGSVGKITGKEGTSFTGKARVYDDEDDFIASLERNEIKKEEKTVVVIRYTGPKGGPGMPEMLKPSSALMGAGLGSSVALITDGRFSGGSHGFLIGHIVPEAAVGGPIALVEDGDIITIDAEKRVLDLEVGEDVLAQRRKKWQEKQEAGLGRPTGLTMRGTLGKYARAVTDASHGCITDGV

SEQ ID NO: 621 - DNA, 1830 bp, Botryotinia fuckeliana
atgctctcacaattgagaacgagggcaaatgcctctcttctcacctcaagaagagcttcacaatatgtgcgctctctatcgtccacatcctctctccgcacatcctccaatgactcagaaccacagctcaacagaacctcagctgctatcacacaaccaaaatcacaaggtgcttcgcaggcaatgttatatgccactggtatgaccgaggaaagattaaacaaagcacaagttggtatctcttcagtatggtggtcgggaaatccttgcaacatgcatcttttggaactcaaccacaaagtaaaggaaggagtagagagagccggtttggtaggatatcaattcaacaccattggagtttcggacggtatttctatgggtacaaagggtatgagatacagtcttcagtcaagagatttgattgcggatagtattgaaactgtgatgggtggtcaatggtatgatgccaacatttcgattcctggatgtgacaagaacatgcctggtgttatgatggcaattggcagagtcaacagaccagcccttatggtttatggtggttctattaaaccagggtgtgccgcaacacaaaacaacgcagatatcgatattgtctccgcattccaagcctacggacaattcattactggagagattacagaagaacaaagattcgatgttattcgtcatgcttgcccaggtcaaggtgcatgtggtggaatgtataccgcaaacaccatggcatcagctatcgaaattatgggaatgactcttcctggatcttctaccaaccccgcagattcaaaggccaaattacttgaatgctacgcagctggtggtgcaatcaaaactcttctcaaggaggacatcagacctagagatatcatgacaagacaggctttcgaaaatgctatggttcttgttaccattactggaggatctaccaacgctgttcttcatcttattgctatggcagatgctgtaggaatcaagctcacaatcgatgatttccaagctgtttctgaccgaacacctttcctcgcagacctcaaaccatctggtaaatacgtcttcaatgatctttacagcatcggtggtactccttctcttatcaaactcctcatcaaggaaggtgtcattgatggatcaggaatgactgttactggtaagacccttgctgagaacgtcaaggatgttcgtgatttcccatccgaccaagaaattattcgcccattctcaaaccccatcaaaaagtctggtcacattcaaattctccgcggttccctcgcaccaggtggatccgttggtaaaatcaccggtaaagaaggattacgattcgttggaaaagctaaggtttatgatgctgaaaatgatttcatcgaagcccttgagcgtggcgaaatcaagaagggagagaagaccgttgtagtcattcgttatgaaggaccaaagggtggaccaggtatgccagaaatgttaaaaccatcctcggcaatcatgggtgcaggacttggaaaggatgtcgctcttattaccgatggacgtttcagtggaggatctcatggattcttgattggacatattgtaccagaggcacaagtcggtggaccaattggattggttagggatggtgatactattgttattgatgctgagacgagagtattggatttggaagttgagggtggtgaggaggaattggagaggaggagaaaagaattcgtcgcacctcctttgaaatataccaagggtactttggcgaaatactcgagattggtacaagatgctagtcatggatgtattaccgatggagaaatcgttgaggcatga

SEQ ID NO: 622 - protein, 609 aa, Botryotinia fuckeliana
MLSQLRTRANASLLTSRRASQYVRSLSSTSSLRTSSNDSEPQLNRTSAAITQPKSQGASQAMLYATGMTEERLNKAQVGISSVWWSGNPCNMHLLELNHKVKEGVERAGLVGYQFNTIGVSDGISMGTKGMRYSLQSRDLIADSIETVMGGQWYDANISIPGCDKNMPGVMMAIGRVNRPALMVYGGSIKPGCAATQNNADIDIVSAFQAYGQFITGEITEEQRFDVIRHACPGQGACGGMYTANTMASAIEIMGMTLPGSSTNPADSKAKLLECYAAGGAIKTLLKEDIRPRDIMTRQAFENAMVLVTITGGSTNAVLHLIAMADAVGIKLTIDDFQAVSDRTPFLADLKPSGKYVFNDLYSIGGTPSLIKLLIKEGVIDGSGMTVTGKTLAENVKDVRDFPSDQEIIRPFSNPIKKSGHIQILRGSLAPGGSVGKITGKEGLRFVGKAKVYDAENDFIEALERGEIKKGEKTVVVIRYEGPKGGPGMPEMLKPSSAIMGAGLGKDVALITDGRFSGGSHGFLIGHIVPEAQVGGPIGLVRDGDTIVIDAETRVLDLEVEGGEEELERRRKEFVAPPLKYTKGTLAKYSRLVQDASHGCITDGEIVEA

SEQ ID NO: 623 - DNA, 1692 bp, Phaeosphaeria nodorum
atgtctctcgcacgctttggaggcgcactttcacgtcccaagtcgcagggcgcctcgcaggccatgctgtacgcgactggcatgagcgaggatgatatgaataaggcccaggtcggcatctcatcagtgtggtactcgggcaacccatgcaatatgcacctgatggacctcaacaacaaggtcaaagagggtgtgcagcgggctggtctcttgggcatgcagttcaacaccattggtgtgagtgacggcatttccatgggcaccaagggcatgcgctactcgctgcagtcgcgtgagatcatcgcagactcgattgagactgtcatgggcggccaatggtacgatgcgaacatttccatccccggatgcgacaagaacatgcccggtgtcatcatggctatgggccgtgtgaaccggccctcgctgatggtctacggcggaaccatccagcctggatgcgcaaagactctcgacaaccagtccatcgacatcgtctctgccttccaggcctacggacaattcataactggagagatcactgaagaccagcgcttcgatgtcatcagacacgcatgcaacggtcagggtgcttgtggaggcatgtacacggcaaacacaatggctactgccattgagaccatgggcatgtcgctgcccggctcatcgtcgaaccccgccaactcgcaggccaagatgctggaatgcctggctgcgggaggcgcaatcaagaacctgctcaaggaggacctgcgccccagcgacatcctcaccaggcaagcactcgagaacgccatggttgtcatcagcatcaccggaggctccaccaacgccgtattacacctgatcgccatcgccgactctgttggtctcaaactgaccatcgacgacttccagagcgtgagcgaccggattccgttgctcgctgatctcaagccctctggcaagtacgtcatggctgatgttcacgacatcgggggtactcccgcactgctcaagttcctgcttaaggagggcctgctcgacggcagccagatgactgtcactggcaagaccctaaagcagaacttggagaacgtcaaggacttcccctccgaccagaagatcatccgccctctcagcgagcccctcaagactaccggccatttgcaaattctccgtggtagtctcgcaccaggtggctgtgtcggcaagatcaccggcaaagaaggaaccatcttcaccggcaaagccaaatgctacgatgccgaagacgacttcatcagtgcgctcgagcgcggcgagatcaaaaagggcgagaagactgtcgtcgtcatccgctacgaaggccccaagggcgggcccggcatgcctgaaatgctcaagcccagctccgccatcatgggcgcaggtctcggcaaggatgtcgcactcatcactgacgggcgcttcagcggtggtagccacggtttcttgatcggccacattgtgcctgaagcgcaggagggcggaccgatcggtcttgtccaggatggcgatgagatcaccatcgactctgagtcgaatgaacttaacattggcgtgagcgagcaggagttggcggagcgcaggaagagctggaaggcgccggcgctgaagtatcaaaagggcacgctgttcaagtatgcgcggttcgtcaaggacgccagctcgggatgcgtgacggactcggcataa

SEQ ID NO: 624 - protein, 563 aa, Phaeosphaeria nodorum
MSLARFGGALSRPKSQGASQAMLYATGMSEDDMNKAQVGISSVWYSGNPCNMHLMDLNNKVKEGVQRAGLLGMQFNTIGVSDGISMGTKGMRYSLQSREIIADSIETVMGGQWYDANISIPGCDKNMPGVIMAMGRVNRPSLMVYGGTIQPGCAKTLDNQSIDIVSAFQAYGQFITGEITEDQRFDVIRHACNGQGACGGMYTANTMATAIETMGMSLPGSSSNPANSQAKMLECLAAGGAIKNLLKEDLRPSDILTRQALENAMVVISITGGSTNAVLHLIAIADSVGLKLTIDDFQSVSDRIPLLADLKPSGKYVMADVHDIGGTPALLKFLLKEGLLDGSQMTVTGKTLKQNLENVKDFPSDQKIIRPLSEPLKTTGHLQILRGSLAPGGCVGKITGKEGTIFTGKAKCYDAEDDFISALERGEIKKGEKTVVVIRYEGPKGGPGMPEMLKPSSAIMGAGLGKDVALITDGRFSGGSHGFLIGHIVPEAQEGGPIGLVQDGDEITIDSESNELNIGVSEQELAERRKSWKAPALKYQKGTLFKYARFVKDASSGCVTDSA

SEQ ID NO: 625 - DNA, 1758 bp, Pichia guilliermondii
atgttatctgctagagtacattctagactattttccacttcggtggtccgttgtgagaaagtgctcaacaagtactcttcgatcgtgacccaggataagtctcaaggtgcttcgcaagccatgttgtatgctacgggctttcaagatgaagatttcgataaggctcaaattggagttggaagtgtatggtggtcaggaaacccttgtaatatgcacttgatggacatgaacgacagatgtacagcttctgtgaacaaggctggattgaaaggaatgcaattcaattccattggagtttctgatggtatcaccaacggtactgatggtatgagatattcattacaatcgagagaaatcattgccgattcatttgagactttagtgatggcccagatgtatgatggtaacattgccattccatcgtgtgacaagaatatgcctggtactcttatggctatgggtagacacaatcgtccatcgattatggtttatggtggtactatcatgcctggatctccttcttgtggtggtgcaaatgttcctgagaagattgatatcattagtgctttccaatcttatggtcaatttttgagtggacagatcaatgaggaacaaagaaaggacattgtaagacatgcttgtccaggtgctggtgcttgtggtggtatgtataccgccaacaccatggcttctgctgctgaggtcatgggtatgtcacttccatactcttcttcagctcctgccatttcgaaagaaaaagctgatgagtgtgacaatgttggttatgccatgaaacatttattagaaattgatttgaaacccaaggatataatgactaaaaagtcctttgagaatgccatcacctacatcattgccactggtggttccacaaatgcggtgttgcacttgattgccattgctcattctgtgggtattgacttgactgttgatgacttccaacgtatttctgataccactccattgttggctgatttcagaccatctggtaaatacgttatggcagatcttcaacaatttggaggtactcctgcggtgatgaaattgttgttggaagaaggtttcctcgatggagaccagtacaccgtcaccggtaataccatcaaagaaaacttatcaaaggtcaagggattgccagccagtcaagacattgttcgtcctgtttctaacccattgaaaccaaatggacacttgcaaattctcaagggtactttagcaccaggaagtgccgttggtaagattactggtaaagaaggtacctactttaagggagctgccagagtgtttgacaatgaagaattgttcatcaaggctcttgaaaagggagagatcaagaagggagaaaagaccgtttgtgtgattcgttatgagggccctaagggtggtcctggtatgcccgaaatgttgaaaccttcttcagcattgatgggttatggtttgggtaaagacgttgcattgttgactgatggtaggttctctggtggttctcatggtttcttgattggtcacatcgtgccagaagccgccgagggtggcccaattgccttggttcacgacggagatgagattgtcattgatgctgaaaacaacaaaattgacttgcttgtctcggaagaaattctcgctgaaagaaagaagctgtggtctcctcctgctccaagatacacgagaggaaccttggccaagtactccaaattggttagtgatgcttccaccggttgtgtaactgacttggactaa

SEQ ID NO: 626 - protein, 585 aa, Pichia guilliermondii
MLSARVHSRLFSTSVVRCEKVLNKYSSIVTQDKSQGASQAMLYATGFQDEDFDKAQIGVGSVWWSGNPCNMHLMDMNDRCTASVNKAGLKGMQFNSIGVSDGITNGTDGMRYSLQSREIIADSFETLVMAQMYDGNIAIPSCDKNMPGTLMAMGRHNRPSIMVYGGTIMPGSPSCGGANVPEKIDIISAFQSYGQFLSGQINEEQRKDIVRHACPGAGACGGMYTANTMASAAEVMGMSLPYSSSAPAISKEKADECDNVGYAMKHLLEIDLKPKDIMTKKSFENAITYIIATGGSTNAVLHLIAIAHSVGIDLTVDDFQRISDTTPLLADFRPSGKYVMADLQQFGGTPAVMKLLLEEGFLDGDQYTVTGNTIKENLSKVKGLPASQDIVRPVSNPLKPNGHLQILKGTLAPGSAVGKITGKEGTYFKGAARVFDNEELFIKALEKGEIKKGEKTVCVIRYEGPKGGPGMPEMLKPSSALMGYGLGKDVALLTDGRFSGGSHGFLIGHIVPEAAEGGPIALVHDGDEIVIDAENNKIDLLVSEEILAERKKLWSPPAPRYTRGTLAKYSKLVSDASTGCVTDLD

SEQ ID NO: 627 - DNA, 1782 bp, Debaryomyces hansenii
atgagtgcattgacaaagtgtaaacgtaacttaggaggtagaaacatccggttattttccaattctgctttgaattgtgacaacaagttaaataagtactcttctattgtgacccagcccaagtcgcaaggggcatcccaagcgatgttgtatgcgaccgggtttgatgaagaagatatgaacaaggcacaggttggtgttggatctgtctggtggtcaggaaatccgtgcaacatgcacttgatggagatgaacaacaaggtgaccgaatctgttaacagagccggtttgaaggggatgcagttcaactcgattggtgtctcggatgggatcactaatggtactgatggtatgagatactcgttgcaatcgcgtgaaattattgctgactcgtttgagaccatgatgatggcccagatgtacgatgccaacatcgcaattccgctgtgtgacaagaacatgccaggtaccttgatggctatgggtagacacaacagaccatctattatggtttacggtggtactattatgccaggttctccaacttgtggtaactcgattattcctgacaagattgatatcatctctgcgttccaatcgtatggtcaattcttatcggaccagatcaatgagggcgaaagaaaggatatcattaagaatgcatgtcctggtgctggtgcatgtggtggtatgtacactgccaacaccatggcctctgctgctgaagttttaggtatgtccttaccattttcgtccagtgccccagccatttcgaaggaaaaggcacatgaatgtgctactgtcggtgatgccatcaagaatttgttagtccttgacttgaagccaatggatatcatgaccaagaaggcttttgaaaatgcaatcacttatattatcgctactggtggttctactaatgccgttttacatttgattgccatggcaaacaccgttggtgttgacttaactgtcgatgatttccaaagaatttcggactccactccattattagccgatttcaagccaagtggtaagtacgttatggctgacttacaaaagtacggtggtaccccagctgtcatgaagttgttattcgaggaaggtttaattgatggatctcaatatactgtcacaggtaagactatcaaagaaaatttggaatctgttaaaggcttgccagctgaacaagaaattgtcagacccttatctaacccattaaagccaagtggccacttacaaattttaaagggtactttagctccaggtagtgctgtcggtaaaattactggtaaggaaggtacttatttcaagggtaaatctagagttttcgatgatgaaatggcattcattactgctttagaaaatggcgaaatcaagaaaggtgaaaagactgtttgtgtcattagatacgaaggtcctcaaggtggccctggtatgccagagatgttgaagccttcttctgcattaatgggttacggtttaggccaagacgttgcgttattaactgatggtagattctctggtggctctcatggtttcttaattggtcatattgttccagaagctgcagttggtggaccaattgcgttagtgcatgatggtgatgaaattgttattgacgctgaaaacaatagaatcgacttattagtatctgaagatattttagccgaaagaaagaaggaatggaccccaccaaagccaagatatacaagaggtacattggctaaatattctaagttagtcagtgatgcttcgttgggttgtgttactgatttggtataa

SEQ ID NO: 628 - protein, 593 aa, Debaryomyces hansenii
MSALTKCKRNLGGRNIRLFSNSALNCDNKLNKYSSIVTQPKSQGASQAMLYATGFDEEDMNKAQVGVGSVWWSGNPCNMHLMEMNNKVTESVNRAGLKGMQFNSIGVSDGITNGTDGMRYSLQSREIIADSFETMMMAQMYDANIAIPLCDKNMPGTLMAMGRHNRPSIMVYGGTIMPGSPTCGNSIIPDKIDIISAFQSYGQFLSDQINEGERKDIIKNACPGAGACGGMYTANTMASAAEVLGMSLPFSSSAPAISKEKAHECATVGDAIKNLLVLDLKPMDIMTKKAFENAITYIIATGGSTNAVLHLIAMANTVGVDLTVDDFQRISDSTPLLADFKPSGKYVMADLQKYGGTPAVMKLLFEEGLIDGSQYTVTGKTIKENLESVKGLPAEQEIVRPLSNPLKPSGHLQILKGTLAPGSAVGKITGKEGTYFKGKSRVFDDEMAFITALENGEIKKGEKTVCVIRYEGPQGGPGMPEMLKPSSALMGYGLGQDVALLTDGRFSGGSHGFLIGHIVPEAAVGGPIALVHDGDEIVIDAENNRIDLLVSEDILAERKKEWTPPKPRYTRGTLAKYSKLVSDASLGCVTDLV

SEQ ID NO: 629 - DNA, 1794 bp, Lodderomyces elongisporus
atgagtttcgctagcaccacaagaaggtgttgcactagatcttttgcctcctccactgttcgtcatgaattagaaaagaaaccattgaaactcaacaagtactcttccgttgtcaccgaggacccttcccaaggagcatcgcaagcaatgctctacgccacagggttctcctccgaggactttaaccgtgcacaaatcggtgtcggatccgtttggtggaccggtaacccttgtaacatgcacttgatggagttaaacaatatgtgtgcagagtcagtcaacaaggccggtttaaaagcaatgcaattcaactcaattggtgttagtgatggtatcaccaacggtacagagggtatgaaatactcattgcaatcacgtgaaatcattgctgactcatttgaaacaatgaccatggctcaattatatgacggtaatgttgccatcccaagttgtgacaagaatatgcccggtgtccttatggcaatgggtagacacaatagacccgccattatggtgtacggaggtacaatcatgcccggctcaccaacttgcggtggctcaaagctgaatcccgccattgcagataagattgacattatcagtgctttccaaagttatggacaattcttgtccaaacaaatcaacgaggaagaaagaattgatattgtgaaaaacgcatgtcctggaccaggtgcttgcggtggtatgtacactgccaacactatggcctctgcagccgaagtcttgggtttaactttacctttttcatcatcggcaccagcagtttcaaaagaaaaggccgaagagtgtgccaacgttgggtacgccatcagaaacttgcttgaactcgacttgaaaccaagagacattttgaccaaaaaatcatttgaaaacgccatcacatacatcattgctaccggtggctcaacaaatgcagttttgcacatgattgccattgcttcaagcttcgatatcgaattaactgttgacgatttccaaagaatcagtgactctactccacttttggctgactttaaaccatctggtaaatacgttatggcagatttgcaagctattggtggtacaccagcagttatgaagtttttgatgaatgaaggtatgattgatggttcgcaattgactgtgacaggtaagaccattgctgaaaacttggccaatgttccagaattgccaaagggtcaagaaatcatccactcattggacaacccattgaaaccaagcggtcacttgcaaatcttgaaaggaaccttggccccaggctcagccgttgccaagattactggtaaagaaggtacttacttcaaaggtaaagctagagtttttgacgaggaacacgcatttatcactgcattggaaaatggcgagatcaaaaagggtgaaaagactgtttgtgtcattagatacgaaggaccaaaaggtggtccaggtatgccagaaatgttgaaaccatcaagtgctttgatgggatacggattgggacaagatgttgccttattgaccgatggtagattttctggtggttcacacggattcttgattggtcacattgtccccgaggcagccgaaggtggtccaattgctcttgttgaggatggcgatgagattgttattgatgccgacaagaacatcattgacttgttggtgagcgaagacgtcttggccaagagaagagagcaatggactccacctgaacccagatacaaaagaggtacattgttcaaatatgccaaattggttagtgatgcttccaaaggatgtgttactgacttgtaa

SEQ ID NO: 630 - protein, 597 aa, Lodderomyces elongisporus
MSFASTTRRCCTRSFASSTVRHELEKKPLKLNKYSSVVTEDPSQGASQAMLYATGFSSEDFNRAQIGVGSVWWTGNPCNMHLMELNNMCAESVNKAGLKAMQFNSIGVSDGITNGTEGMKYSLQSREIIADSFETMTMAQLYDGNVAIPSCDKNMPGVLMAMGRHNRPAIMVYGGTIMPGSPTCGGSKLNPAIADKIDIISAFQSYGQFLSKQINEEERIDIVKNACPGPGACGGMYTANTMASAAEVLGLTLPFSSSAPAVSKEKAEECANVGYAIRNLLELDLKPRDILTKKSFENAITYIIATGGSTNAVLHMIAIASSFDIELTVDDFQRISDSTPLLADFKPSGKYVMADLQAIGGTPAVMKFLMNEGMIDGSQLTVTGKTIAENLANVPELPKGQEIIHSLDNPLKPSGHLQILKGTLAPGSAVAKITGKEGTYFKGKARVFDEEHAFITALENGEIKKGEKTVCVIRYEGPKGGPGMPEMLKPSSALMGYGLGQDVALLTDGRFSGGSHGFLIGHIVPEAAEGGPIALVEDGDEIVIDADKNIIDLLVSEDVLAKRREQWTPPEPRYKRGTLFKYAKLVSDASKGCVTDL

SEQ ID NO: 631 - DNA, 1764 bp, Vanderwaltozyma polyspora
atgactattgcaagcaaggcattgagtgctagacacttttcagtcactagaaatgttagtaagaagttgaataagtactcttatatcgttacagaacctaaggaccaaggtgcatcacaagcgatgctttatgcaactgggttcaagaaagaagattttagtaaaggtcaagttggtgtaggatcatgttggtggtctggtaatccatgtaatatgcatttattggatcttaatgatagatgttcacgttctgtggagaaggctggcttgaaagctatgcaatttaataccattggtgtttccgatggtatttcaatgggtactaaaggtatgagatactctttacagagtagagaaatcattgctgattcttttgaaactataatgatggctcaacattacgatgccaatattgctatcccttcatgtgataaaaacatgccgggtgtcatgatggccatgggaagacataacagaccttctatcatggtttatggtggtactattttacctggccatccaacctgtggttcttcaaaaattccagaaaacattgatatagtatctgctttccaatcttatggtcaatatatatctaaacaattcagcgaacaagagagagaagatgtggttgaacatgcttgtcctggtccaggttcttgtggtggtatgtatactgctaacactatgggttctgtcgcagaagtgctaggtttgactttgccaaactcttctgccttcccagcagtttctcaagaaaagatgaatgaatgtgattccattggtgaagctattaagaagacaatggaattaggtatcactcctcgtgatatcatgactaagcaagcttttgaaaatgcaatcacctatgttatcgcaaccggtggttccaccaatgctgttttgcacttggttgccattgctcattctgctggtgtcaagattactcctgatgatttccaaagaatcagtgataagaccccattattgggtgattttaaaccatcgggtaaatacgttatggctgatttaatcaaagtaggaggtacccaatctgttatcaaattcttgtacgaaaacggtttcttgcatggtgatgccattactgttactggtgatacattagccgaacgtgctgccaaaacttctggattaccagaaggccaagatataatcagacctgtttcacaacctattaaaccaaatggccatctacaaatattgtatggctcattggctccaggtggtgctgtcggtaaaatcactggtaaagaaggtactttctttaaaggtagggctcgtgtttttgaagaagaagaagctttcattcatgcattggaaagaggtgaaattaagaaaggtgaaaaaaccgttgttgtcatcagatatgaaggtccaaaaggtggtccaggtatgccagaaatgttgaaaccatcctctgcgctaatgggttacggtttaggtaaagatgttgccttgttaactgatggtagattttctggtggttcccatggattcttaatcggtcacattgttccagaagctgccgaaggtggtccaattggtttagttaaagatggagacgaaattgttattgatacaaataacaacaagatagatttattagtatccgaacaagaaatagcccaacgtaaatcagagtgggttaaaccagctccacgttacaccagaggtactctatccaagtacagtaaattggtatctaacgcttctaacggttgtgtattagacgctgacaattga

SEQ ID NO: 632 - protein, 587 aa, Vanderwaltozyma polyspora
MTIASKALSARHFSVTRNVSKKLNKYSYIVTEPKDQGASQAMLYATGFKKEDFSKGQVGVGSCWWSGNPCNMHLLDLNDRCSRSVEKAGLKAMQFNTIGVSDGISMGTKGMRYSLQSREIIADSFETIMMAQHYDANIAIPSCDKNMPGVMMAMGRHNRPSIMVYGGTILPGHPTCGSSKIPENIDIVSAFQSYGQYISKQFSEQEREDVVEHACPGPGSCGGMYTANTMGSVAEVLGLTLPNSSAFPAVSQEKMNECDSIGEAIKKTMELGITPRDIMTKQAFENAITYVIATGGSTNAVLHLVAIAHSAGVKITPDDFQRISDKTPLLGDFKPSGKYVMADLIKVGGTQSVIKFLYENGFLHGDAITVTGDTLAERAAKTSGLPEGQDIIRPVSQPIKPNGHLQILYGSLAPGGAVGKITGKEGTFFKGRARVFEEEEAFIHALERGEIKKGEKTVVVIRYEGPKGGPGMPEMLKPSSALMGYGLGKDVALLTDGRFSGGSHGFLIGHIVPEAAEGGPIGLVKDGDEIVIDTNNNKIDLLVSEQEIAQRKSEWVKPAPRYTRGTLSKYSKLVSNASNGCVLDADN

SEQ ID NO: 633 - DNA, 1746 bp, Ashbya gossypii
atgatgtctcacaggcggttctcgacagcgcagcggctgcgcgaggggctaaacaggtactcgagggtcataaccgagccgcgggcgcagggtgcctcgcaggccatgctgtacgcgactggtttcggtgatggggactttgcaaaggcgcaggtcggagtggggtcgtgctggtggtcgggcaacccatgcaacatgcatctgatggacctgaataaccgggtagcggcgtctgtggaccgggcgggcttgaaggcgatgcagttcaacacaatcggtgtctcggacggcatttctatggggactaccggcatgcggtactcgctgcagtcgcgcgagatcattgcagactcttttgagaccatgatgatgggtcagcactacgatggcaacgtggcaattccctcctgcgacaagaacatgcccggcgtgataatggccatggcgcggcacaaccggccctccattatggtctacggcggcaccatcatggcggggtccccttgcagcggctctacgcggctgccaaagaagattgatgttgtatctgcgttccaggcgtacgggcaatatctgtcgaagcagattacggaggaggaaagcagggatgtcgtccgtcacgcctgtccgggtccgggctcttgcggtggcatgtacacagccaacacaatggcctcagccgccgaggttctgggactgactctgcccaactcgtctgcgttcccggcgatctccgaacagaagctggccgaatgtgacgccgttggggatgccatgcgcaaagcgctcgagctcaacatcaggccacgcgacctgctcacaagggaagccttcgaaaacgcgatcacgtacgtgattgcgactggtggctcgaccaacgcagtgctccacctggttgctattgcccactctgcgggcgtgaaactgacgccggatgacttccagcgcatttccaacaaaactccgttgctgggcgacttcaagccatccggaaagtacgtcatggctgacctcattgaggttgggggtacacaggccgtcatcaagtttttgtatgaaaatggcttcatgcacggagatgccctaacggtgacaggagacacgctcaaggagcgggctgcgaagactgctcccttgcccgaaggccaggacatcattcgtcccgtgtcgcagccattgaatcctaggggacatctccagattctctatggctctcttgcgccaggcggcgctgtcggcaagatcaccgggaaggaggggaccttcttccagggccgcgcacgcgttttcgatgaagaaaacgcattcatccgcgccctggaggagggccagatcaagaagggtgagaaaaccgttgtggtcatcaggtatgaaggccccaagggtgggcccggcatgccagaaatgctcaaaccgtcttccgcgctgatgggctacggtctgggcaacgatgttgccttgctgaccgacggccgcttctccggcggctcccacgggtttttgatcggccacattgtccctgaggcctatgaaggcggcccaattgcgctcgtgcaagacggtgacgacattgtcatcgacgccgagaacaatgccatcaacctccttgtgccaaaagaagaaattgagtcgcgccgcgctcgctggacccagccggctccacgctacaagaggggcacgctcgccacctattctaagttagtctccaacgcctccaagggttgtgtcttggacagcgacgactag

SEQ ID NO: 634 - protein, 581 aa, Ashbya gossypii
MMSHRRFSTAQRLREGLNRYSRVITEPRAQGASQAMLYATGFGDGDFAKAQVGVGSCWWSGNPCNMHLMDLNNRVAASVDRAGLKAMQFNTIGVSDGISMGTTGMRYSLQSREIIADSFETMMMGQHYDGNVAIPSCDKNMPGVIMAMARHNRPSIMVYGGTIMAGSPCSGSTRLPKKIDVVSAFQAYGQYLSKQITEEESRDVVRHACPGPGSCGGMYTANTMASAAEVLGLTLPNSSAFPAISEQKLAECDAVGDAMRKALELNIRPRDLLTREAFENAITYVIATGGSTNAVLHLVAIAHSAGVKLTPDDFQRISNKTPLLGDFKPSGKYVMADLIEVGGTQAVIKFLYENGFMHGDALTVTGDTLKERAAKTAPLPEGQDIIRPVSQPLNPRGHLQILYGSLAPGGAVGKITGKEGTFFQGRARVFDEENAFIRALEEGQIKKGEKTVVVIRYEGPKGGPGMPEMLKPSSALMGYGLGNDVALLTDGRFSGGSHGFLIGHIVPEAYEGGPIALVQDGDDIVIDAENNAINLLVPKEEIESRRARWTQPAPRYKRGTLATYSKLVSNASKGCVLDSDD

SEQ ID NO: 635 - DNA, 1704 bp, Laccaria bicolor
atgaaccggcacagcagggtggtcacccaacccaaagaccaaggtgctagtcaggccatgctgtatgctacggacggcatcaaaacggatgatgacttcaacaaagccatggtcggcgtcgccagcgtctggtacgagggtaatccatgcaataaacatctccttggtctgggtcaagaaatcaaagcttcacttacaaagtctggtatcataggctaccagtttggtaccgttggagtcagcgatgggatcagcatgggaacgcgcggcatgtcctactccctccaatcccgagacctgattgcagatcaagtagagaccgctgccggaggacaccatctcgacgggatggtcgtcgttcccggctgcgataaaaatatgcctggtgttctgatggcccttgggcgtctcaaccgccctggacttatggtgtatggtgggacaattcgtgccgggtcgtgtgaaggagcgccacagttggacatcgtgtccgctttccagtcctacggaaagtacctgcaggacggaaagacacccgaagcggaacgcgaacgatataataccgttcgacatgcctgcccaggaccaggcgcttgtggtggtatgtacacagcaaacactatggcaagtgcggcggaggcactggggatgacagtccccggatcatcatccttcccagccgaatccctggaaaaacacaacgagtgtgcttcgattgggaaagttatgtacaaccttcttgagaaaaacatacttccacgggatatcatgactagatccgcgtttgaaaatgctatggtcctcacgatgattctaggcggttccaccaatgcagttctccatctaatagctatggctcactccgtgggcattaaattggatatcgacgacttccaaaacgtgtcagaccgcacccccttcctcgccgacatcaaacccagtggcaaatatgtcatggaagatgtgtacaagatcggtggaatcccaaaaattttggcgttcttgctaaagaacaagctaatcgacggaaataatatgactgtcacgggtcgaaccctcggcgaaaaccttgaggaatggacacacagatacggcgaactggattctcgacaagacgttattcgacctctcaacaaacccataaaagagacagggcacatccgaatcctcaaaggcaatcttgctcctggcggtgcggtggctaagatcacaggcaaagaaggcttggaatttactggcaaggcacggactttcgacacagaagacgatttcgtcaaggccgtcgaaagcgggtctatcaaaaagggtgaaaaaacggtcgtcattcttcggtatctcggccctcagggaggacctggcatgcctgagatgctgaaacccacaagcttaatcatgggagccggcttgggattggacgttgcctgtctcacagatggaagattcagcggcggatcccatgggttttgtattggacacgtcgttcccgaggcacaggttggtgggcccatagcgctcgtcagggacggagacaccattgtcgtcgatgccatcaagaacactatcgagctccgcgtctcacccgaggagttaacgaagagaaaagagtcttggattccacctgccctcaaggtatcccagggaacgttgtacaagtatactaagagtgttacagacgcgagccatgggtgtgtgacggacgcatga

SEQ ID NO: 636 - protein, 567 aa, Laccaria bicolor
MNRHSRVVTQPKDQGASQAMLYATDGIKTDDDFNKAMVGVASVWYEGNPCNKHLLGLGQEIKASLTKSGIIGYQFGTVGVSDGISMGTRGMSYSLQSRDLIADQVETAAGGHHLDGMVVVPGCDKNMPGVLMALGRLNRPGLMVYGGTIRAGSCEGAPQLDIVSAFQSYGKYLQDGKTPEAERERYNTVRHACPGPGACGGMYTANTMASAAEALGMTVPGSSSFPAESLEKHNECASIGKVMYNLLEKNILPRDIMTRSAFENAMVLTMILGGSTNAVLHLIAMAHSVGIKLDIDDFQNVSDRTPFLADIKPSGKYVMEDVYKIGGIPKILAFLLKNKLIDGNNMTVTGRTLGENLEEWTHRYGELDSRQDVIRPLNKPIKETGHIRILKGNLAPGGAVAKITGKEGLEFTGKARTFDTEDDFVKAVESGSIKKGEKTVVILRYLGPQGGPGMPEMLKPTSLIMGAGLGLDVACLTDGRFSGGSHGFCIGHVVPEAQVGGPIALVRDGDTIVVDAIKNTIELRVSPEELTKRKESWIPPALKVSQGTLYKYTKSVTDASHGCVTDA

SEQ ID NO: 637 - DNA, 1797 bp, Coprinopsis cinerea
atgccgccaaaatatctcccaattcgtcgtcaatggctccggtcagcgagaggcttgtctacaaccgcacggtgcagtgacaagcccgtcctgaaccggtacagcaggatcatcacccagcccaaggaccagggagcaagtcaggctatgctctatgctacagatggcataaagtcggacgcggacttcaacaagccgatggtcggtgtcgccagcgtatggtatgagggcaacccatgcaacaagcaccttctcggacttggccaggaaatcaaggcttcccttaccgaggcagacatcataggctaccagtttggtacggtcggtgtcagcgacggtattagtatgggtacgaaaggaatgtcgtattccctccagtcgcgagacttaatcgctgaccaggtggaaactgctgccggaggtcatcatctcgatggcatggtagtagtccctgggtgcgacaagaatatgcctggtgttctcatggctcttggccgtctcaaccgaccaggtctcatggtctacggtggaaccattcgcgcaggctcgtgtgaaggcatgcctcaattggatatcgtttctgctttccaggcctacggaaaataccttcaagacggaaggacacccaaggctgaggaagaacgatacaacaccgttcgacacgcctgtcctggtcctggtgcttgcggtggcatgtacactgcaaacacaatggcaagtgcagcggaggctttgggaatgacccttcccggttcttcctccttcccagcgcagtcagaggagaaacatctagagaccaagtctatcggttctgtgatgtacaacttgcttgagaagaacattttgccgagggacatcatgacgcgctctgcctttgaaaacgcgatggtcctcaccgtcatcctcggaggctcaaccaacgcagtcctccatttgatcgccattgctcactcagtcggcatcaaactcgacattgacgacttccaaaaggtgtccgaccggatacccttccttgccgacttgaagcccagcggaaaatatgtcatggaagatgtctacaagatcggtggtatccccaaggttctcgcgttcttgctcaagaacaatttgatcgatggtaataacatgactgttactggtcgcactgtcggagagaacttggaccgatggacgcacaagtacggcgagctccacttcgacaagcaggatgtcatccgacctctggataagcctatcaaggagactggtcacatccggattttgaagggtaacctcgcccctggtggcgccgtcgccaaaatcaccggaaaagaaggccttggtttcgtcggcaaagcacgtgtatttgattctgagaacgacttcgtcaaggctgtggaatctggtagcatcaagaagggcgagaaaaccgttgttattttgcggtatctcggtcctcagggtggacctggaatgcccgagatgcttaagcctaccagtttggtgatgggcgctggattgggtatggatgtcgccatcttgactgacggacgatttagcggaggatcgcacggattctgtatcggacacgtcgttccggaagcgcaagtcggtggccctatcgccttggtcgaggacggcgacatcatctcggttgacgctgtgaagaacacgatcgagttgcaggtccctgaacccgagcttgccgcgcgaaaggctgcatggaaggcaccccctctcaaggtcacccagggcaccctctacaaatacgccaaggttgtcaccgatgccagccatgggtgtgtcactgatgcttaa

SEQ ID NO: 638 - protein, 598 aa, Coprinopsis cinerea
MPPKYLPIRRQWLRSARGLSTTARCSDKPVLNRYSRIITQPKDQGASQAMLYATDGIKSDADFNKPMVGVASVWYEGNPCNKHLLGLGQEIKASLTEADIIGYQFGTVGVSDGISMGTKGMSYSLQSRDLIADQVETAAGGHHLDGMVVVPGCDKNMPGVLMALGRLNRPGLMVYGGTIRAGSCEGMPQLDIVSAFQAYGKYLQDGRTPKAEEERYNTVRHACPGPGACGGMYTANTMASAAEALGMTLPGSSSFPAQSEEKHLETKSIGSVMYNLLEKNILPRDIMTRSAFENAMVLTVILGGSTNAVLHLIAIAHSVGIKLDIDDFQKVSDRIPFLADLKPSGKYVMEDVYKIGGIPKVLAFLLKNNLIDGNNMTVTGRTVGENLDRWTHKYGELHFDKQDVIRPLDKPIKETGHIRILKGNLAPGGAVAKITGKEGLGFVGKARVFDSENDFVKAVESGSIKKGEKTVVILRYLGPQGGPGMPEMLKPTSLVMGAGLGMDVAILTDGRFSGGSHGFCIGHVVPEAQVGGPIALVEDGDIISVDAVKNTIELQVPEPELAARKAAWKAPPLKVTQGTLYKYAKVVTDASHGCVTDA

SEQ ID NO: 639 - DNA, 1791 bp, Cryptococcus neoformans
atgctttcaagacgcatcgctactgcaagcccagccgctcatactagagcattccatgcgtcggctgccaaggcctcgaaagaggtcataatgaatcgttactctaggactattactcaacctaaggctcaaggcgcttctcaggccatgctttacgccacggaaggcattgtgaatgacgaagacttcaataaggccatggttggcgttgccagtgtttggtacgaaggcaacccatgcaatcgacacattttgggccttggccagagggtgaagaagtctcttatgaatgctggcatcgttggctaccaatttggtactgtcggtgtctctgacggtattagcatgggtacctctggaatgtcttactccctgcaatctcgtgacctcattgccgactctgttgagacggctgctggtggtcattggctggatgggatggtcgttttacctggttgcgataaaaacatgcctggtgctttgattgctctcggtcgacttaatcgacccagtatgatggtttatggcggtactatccgtcctggctcttgtggcggagaggtgctcgacattgtgtcagctttccagagttatggacgatacctccaagaaggccaaacacctgaggctgaaaagacccgctacaataccattcgaaacgcatgtcctggtcctggagcctgtggaggcatgtacactgctaacacaattgcgtccgcctccgaagccttgggtatgactcttcctgggtcgtcgtctttccctgcggaatatcctgaaaagcatgcggaatgtgacgctgttggcgagactatgcgcaaggttttggaagataaccttctccccagacaaatcatgaccaggcaggctttcgaaaatgcaatggctcttacaatggcgctcggtggatctaccaacgttgttctccatttgatcgccatcgctcggtcggttggtatcaaccttaccattgacgatttccaaacggtctccgatcgagtacctttgctggccgatctcaaacccagtggtaaatacgttatggaagacatcaacaccatcggtggcacgccttccgtcattcactatctgatcaaaaacggaattatgaccggtgacgagatgaccatcaccggtaagactcttggagagaattgtgatcgctgggtggaggagcacggtagcaagtgggaaggacagaagattttgcgacctattaacgatcctcttaagtccactggacacatccgaattctgcgcggtaatcttgcccctggaggtgctgtctctaagatcacaggcaaagaaggcttgcgctttaccggtaaatgccgggctttcgatgatgaggagggcttcgtgaaggccgtcgaaagcggttctatcaaaaagggagagaaaactgttgttgtcttgaggtaccttggccccaagggcggacctggtatgcctgaaatgctcaaacctaccagtttgatcatgggcgctggtctaggatatgatgtcgcttgtctgacagatggacgatttagcggaggttctcatggcttcgttgttggccatgtcgttccggaggcccaggttggaggacccattgctttggttcaagacggcgatgttattcatattgatgccgttgcgaacactttgtctgtggacgtatccgacgaagagatggcccgcagaaaggagaactgggttgcccctcctctcaaggtcactcacggaacattgctcaaatacgcccgagctgttaccgatgcttctcatggatgtgtcacggatgcttaa

SEQ ID NO: 640 - protein, 596 aa, Cryptococcus neoformans
MLSRRIATASPAAHTRAFHASAAKASKEVIMNRYSRTITQPKAQGASQAMLYATEGIVNDEDFNKAMVGVASVWYEGNPCNRHILGLGQRVKKSLMNAGIVGYQFGTVGVSDGISMGTSGMSYSLQSRDLIADSVETAAGGHWLDGMVVLPGCDKNMPGALIALGRLNRPSMMVYGGTIRPGSCGGEVLDIVSAFQSYGRYLQEGQTPEAEKTRYNTIRNACPGPGACGGMYTANTIASASEALGMTLPGSSSFPAEYPEKHAECDAVGETMRKVLEDNLLPRQIMTRQAFENAMALTMALGGSTNVVLHLIAIARSVGINLTIDDFQTVSDRVPLLADLKPSGKYVMEDINTIGGTPSVIHYLIKNGIMTGDEMTITGKTLGENCDRWVEEHGSKWEGQKILRPINDPLKSTGHIRILRGNLAPGGAVSKITGKEGLRFTGKCRAFDDEEGFVKAVESGSIKKGEKTVVVLRYLGPKGGPGMPEMLKPTSLIMGAGLGYDVACLTDGRFSGGSHGFVVGHVVPEAQVGGPIALVQDGDVIHIDAVANTLSVDVSDEEMARRKENWVAPPLKVTHGTLLKYARAVTDASHGCVTDA

SEQ ID NO: 641 - DNA, 1833 bp, Ustilago maydis
atgctgcgatccgccctcagtccctcagcacgttgcgtcctgcgcggcggcctcgcctcccgccgcgctctccacacctcctcagccgctctcaacacagagcgcgctccgccgggcgctctaaacaagtactcgcgtatcatcacccggcccaaggatcagggagcatcgcaagccatgctctacgccaccgacggcatccagtcggacgaggacctcacgcgtgctatggttggtatcggctcgatttggtacgagggcaacccatgcaacgcgcacctgctcgccatctcgcagcgcgtcaaaaagtcggtgcagcaagccggtctcaccggttatcagtttggatctgtcggtgtttcggatggtatctcgatgggtacagacgccatgtcgtactcgctcccgtcgcgtgatctgatcgctgactcggtggaatcggcttgcggtggtcattggcttgatggctgtgtggtgattcccggttgcgacaagaacatgcctggtgtgctgatggctctcggccgtctgaatcgtcccggaatcatgctctacggcggaacgatccgtcccggtggatgtgctagcgtcgagggcacgctcgacattgtctctgctttccagtcgtacggccagtacctcgccaacggaggctctccggctgctgaaaagattcgctatgacaccgtccgcaacgcctgtcccggtcccggtgcgtgcggtggcatgtacaccgccaacaccatggcttcatgcgccgaggctctcggcatgacgctcccaggtagctcgtcgttcccggcagaataccctgaaaagatcgccgaagccgaaaatatgggagccgccatgcgcctcgtcctcgaaaaggacatcaagccgcgcgacatcatgacgcgatccgccttcgaagatgcgatcgctctcaccatggttctcggaggcagcacgaatgcagtcttacatctgattgctgtcgctcactcggtcggcatcgagctcagcattgacgacttccagcgcatcgccgacgtgactccattccttgccgacctcaagccgtcgggcaagtacgtgatggaagatgttcactcgaaactcggcggtatcccgacgattattcagtactgcatcgagaacaagctgatgaagggtgaacacatgaccgtcaccggtcgaacgcttgccgagaacgtcgaccgatggacgcacgagcgcggcaaactgcctgcaggccaagacgtgctccgaccgatcgacaagcctctcaagagcaccggccacattcgaatcctcaagggcaatcttgcgcctggtggcgccgtcgccaagatcactggaaaagagggtctgcgattcacaggtaaagcgcgcgtctttgacaccgaagatgccatggttggcgccgttgaaaagggcgagatcaagaagggtgaaaagacagtgatcgtgttgcgctacaagggtcctaagggtggacctggtatgcccgagatgctcaaacctaccagtttgatcatgggcgctggtcttgggcaggatgtagcctgtttgaccgacggtcggttctccggtggaagtcacggtttcgtcatcggtcacgtcgttcccgaggcacaggtcggaggtccgatcggcctcgtaaaggatggtgatgtgatcagcatcgatgccgagaccaacacgttggagcttgtcggtgtatccgctgccgatctcgagtcccgaagagagtcgtggaagcctctaccgctcaaaccgaaatcgggccacctgctcaagttcgttcgtaacgttgccgatgcttcgcatggttgcatcaccgatatgtga

SEQ ID NO: 642 - protein, 610 aa, Ustilago maydis
MLRSALSPSARCVLRGGLASRRALHTSSAALNTERAPPGALNKYSRIITRPKDQGASQAMLYATDGIQSDEDLTRAMVGIGSIWYEGNPCNAHLLAISQRVKKSVQQAGLTGYQFGSVGVSDGISMGTDAMSYSLPSRDLIADSVESACGGHWLDGCVVIPGCDKNMPGVLMALGRLNRPGIMLYGGTIRPGGCASVEGTLDIVSAFQSYGQYLANGGSPAAEKIRYDTVRNACPGPGACGGMYTANTMASCAEALGMTLPGSSSFPAEYPEKIAEAENMGAAMRLVLEKDIKPRDIMTRSAFEDAIALTMVLGGSTNAVLHLIAVAHSVGIELSIDDFQRIADVTPFLADLKPSGKYVMEDVHSKLGGIPTIIQYCIENKLMKGEHMTVTGRTLAENVDRWTHERGKLPAGQDVLRPIDKPLKSTGHIRILKGNLAPGGAVAKITGKEGLRFTGKARVFDTEDAMVGAVEKGEIKKGEKTVIVLRYKGPKGGPGMPEMLKPTSLIMGAGLGQDVACLTDGRFSGGSHGFVIGHVVPEAQVGGPIGLVKDGDVISIDAETNTLELVGVSAADLESRRESWKPLPLKPKSGHLLKFVRNVADASHGCITDM

SEQ ID NO: 643 - DNA, 1770 bp, Malassezia globosa
atgtcgacgacatgtgcttgcaccacagcaaagaaggatcgcccagcaccaggtgatctgaatcggtactcgcgcttgataacgcaaccaaaagatcagggtgcatcacaggcaatgttgtatgccacgcacggaatccagtcagatgaggatttacgacgtgccatggttggcgtggccagtgtctggtacgaaggcaacccatgcaacgcgcacttgctgggcgttggacagcgaattcgagattctctcgacagggccggcctgacaggctaccaatttggcacagtcggcgtgtctgacggtattagcatgggaaccagtgccatgtcgtactcgcttccgagtcgggatctcattgccgacagcgttgaaagctgcatgggtggccattggcttgatggatgtgttgtggtgccagggtgtgacaagaacatgccgggtgtgctcatggcacttggccgtctgaatcgtccaggcattatggtatatggtggcacgattcgccctggccactgcggatcgatcacaggtacacttgacattgtgagcgcgttccagagttacggacagtacctggcatcaggcggcacgcccgatgccgaaaagatccgctacgacactgtacgtcatgcgtgcccaggaccaggtgcttgcggtggtatgtacacggccaataccatggcatcatgtgcagaggtgctgggtatgacactacccggcagtagctctttccctgccgaatacaacgagaagaaggccgaatgtgacagtattgggccaacgatgcgcatgctgcttgagaagaacattcgcccgcgagatattatgacgcgcagcgcattcgaagatgcaatggtacttacgatggtgctgggtgggtcgacgaatgctgtattgcacctgctcgccatggcccgaagcgtgggcgtagacctatctatcgatgacttccaacgcgtgagtgattcaactccgttccttgccaatctgaagccaagtggccagtacgtcatggaagacgtacacaccgtactgggcggcattccttccgttgtacactacttgattgagaacaaactcatgaaaggtgagcacatgactgtaacgggtcgaacactgcgtgaaaactgtgagcaatgggttgcagagcgcggtcccatgcccaaggaccaagatgttctccgccccatcgacaagccgatcaagcgtacaggccacatccgtgttctttacggcaacctagctcccggtggtgctattgccaagatcacaggcaaggaaggtctcgaatttacagggaaagcacgcgtatttgacacggaagatgacatggtgcatgctgtcgagcaagggacgatcaaaaagggcgagaagactgtggtgatacttcgctacaaaggtcccaagggcggtccagggatgcctgaaatgctcaagccaacgagtttgatcatgggcgcaggtctcggtcacgacgttgcttgcctcacagacggccgctttagcggcggttcgcacggcttcgtgattggacatgtcgttcccgaagcacaagagggtgggccgattgcccttgtgcgggatggcgatgaaatcactatcgatgcggtgaacaactcgatccagatcaacaatgtctcagacgaggagctcgcgcagcgccgcgccgcttggcaaccccggcctcttacagtcaaccagggcggcttgtataaatacacgcgactcgtatcaaacgcaagtcagggctgtgtgacagatgcatga

SEQ ID NO: 644 - protein, 589 aa, Malassezia globosa
MSTTCACTTAKKDRPAPGDLNRYSRLITQPKDQGASQAMLYATHGIQSDEDLRRAMVGVASVWYEGNPCNAHLLGVGQRIRDSLDRAGLTGYQFGTVGVSDGISMGTSAMSYSLPSRDLIADSVESCMGGHWLDGCVVVPGCDKNMPGVLMALGRLNRPGIMVYGGTIRPGHCGSITGTLDIVSAFQSYGQYLASGGTPDAEKIRYDTVRHACPGPGACGGMYTANTMASCAEVLGMTLPGSSSFPAEYNEKKAECDSIGPTMRMLLEKNIRPRDIMTRSAFEDAMVLTMVLGGSTNAVLHLLAMARSVGVDLSIDDFQRVSDSTPFLANLKPSGQYVMEDVHTVLGGIPSVVHYLIENKLMKGEHMTVTGRTLRENCEQWVAERGPMPKDQDVLRPIDKPIKRTGHIRVLYGNLAPGGAIAKITGKEGLEFTGKARVFDTEDDMVHAVEQGTIKKGEKTVVILRYKGPKGGPGMPEMLKPTSLIMGAGLGHDVACLTDGRFSGGSHGFVIGHVVPEAQEGGPIALVRDGDEITIDAVNNSIQINNVSDEELAQRRAAWQPRPLTVNQGGLYKYTRLVSNASQGCVTDA

SEQ ID NO: 645 - DNA, 1824 bp, Aspergillus clavatus
atggatgcctccaaccccgcgctgtccagcacatccgaagcaaaatatatcaacttccccagtcttcccgatgacgcaaaacacgacgacggcacgcttgcgctgaatagatactcgtcctatatcactcgcggccatgacttccctggtgcccgggcaatgctgttcgcggcgggtatcccagatcgcgatgccatgacaaagagcccccaggttggtgttgccagtgtctggtgggagggaaacccgtgcaacatgcacctgttggatttgggcaagacggtcaagaaagccgtcacggagcagggcatgatcggatggcagtataacacgattggggtttcggatgggattacgatgggtagtgatgggatgcgattttctctgcagacgcgcgagatcatcgccgatagtgtcgagacagtgacatgtgcgcagtaccatgatgcctgtattgccatccctggatgtgacaagaacatgcctggcgtggtgatgggcatggcacggcacaatcggccgtcgatcatgatctacggtggcacgattcagatcggctattccaatctcctgcggaagcctatcaacgtgtcgtcttgtttcgaggccgcgggcgcatatgcatacgacactttgcgccaaccggacgacggaggcgataccagcaagaccaaggatgagatcatggatgacctggagagacacgcgtgccccacggcaggcgcctgcggaggcatgttcacggcaaacacgatggccacggcgatcgagtcgatggggctgtctctgcccggatcatcgtcgacacctgcgtcgtcgccatcgaagatgcgggagtgcgtcaaggcggctgaagccatcaaggtctgcatggagaagaacatcaagccccgagatctgttgaccaagcggtcatttgagaacgccctggttatgaccatggcgctgggcggaagcaccaatggtgtcttgcatttcctcgccatggccaggacggccgaggtggatctcaccttggatgatatccagcgagtgagcaataagatccccttcatcgcggatctggctccgagcgggaagtactacatggcggacctgtatgatatcggaggcattccgtctgtgcagaagctgctgatcgcagcgggtctcctcgacggcgatatccccacagtcactggcaagacgttggccgagaacgttgcctccttcccatcgctgcctcaagatcaagtcatcattcgccctctcgataagcccatcaaggcgactgggcacctgcagatcttgcgcggaaacctggcacctggaggagcagtcgccaagatcaccggaaaggagggaaccaaattcacaggcaaagcccgtgtctttaataaggagcatcaattgaacgatgctgtgacccagggcaaaattcctcgtggcgagaacctggtgcttattgtccgttacgaaggccccaagggcggaccgggtatgccggaacagctcaaagccagtgcagcgctcatgggagccaagctcaacaacgtggcgctgatcacagatgggcgatactcaggagccagtcacgggttcatcgtcggccatattgtccccgaagctgcagttggcggaccgattgctgttgtccgtgacggcgatgtgattaccatcgatgcggagaccaacaccatcagcatggatgtttcggacgaggagattcgacagcgtctgaaggaatggaagcccccaacgccccatgtcacacgtggcgtactagccaagtatgccaggctggttggagatgcctctcatggcgcgatgacggatctattctag

SEQ ID NO: 646 - protein, 607 aa, Aspergillus clavatus
MDASNPALSSTSEAKYINFPSLPDDAKHDDGTLALNRYSSYITRGHDFPGARAMLFAAGIPDRDAMTKSPQVGVASVWWEGNPCNMHLLDLGKTVKKAVTEQGMIGWQYNTIGVSDGITMGSDGMRFSLQTREIIADSVETVTCAQYHDACIAIPGCDKNMPGVVMGMARHNRPSIMIYGGTIQIGYSNLLRKPINVSSCFEAAGAYAYDTLRQPDDGGDTSKTKDEIMDDLERHACPTAGACGGMFTANTMATAIESMGLSLPGSSSTPASSPSKMRECVKAAEAIKVCMEKNIKPRDLLTKRSFENALVMTMALGGSTNGVLHFLAMARTAEVDLTLDDIQRVSNKIPFIADLAPSGKYYMADLYDIGGIPSVQKLLIAAGLLDGDIPTVTGKTLAENVASFPSLPQDQVIIRPLDKPIKATGHLQILRGNLAPGGAVAKITGKEGTKFTGKARVFNKEHQLNDAVTQGKIPRGENLVLIVRYEGPKGGPGMPEQLKASAALMGAKLNNVALITDGRYSGASHGFIVGHIVPEAAVGGPIAVVRDGDVITIDAETNTISMDVSDEEIRQRLKEWKPPTPHVTRGVLAKYARLVGDASHGAMTDLF

SEQ ID NO: 647 - DNA, 1827 bp, Neosartorya fischeri
atggactcctctacctccacgtcgtccaacacccagggcgaagccaagtatatcaacttccccagtcttcctgacgacgcaaagcatgaagatggcacccctgcgctgaacagatattcttcttatatcactcggagccatgactttcctggtgctcgggctatgctttttgcagcgggaattccggatcgcgaagcgatggctaagagtccacaggtgggaattgccagtgtctggtgggagggaaatccttgcaatatgcacctgctggacttgggcaagacggtgaagaaggccgttacggatcagggcatgaccggttggcagtataataccattggagtttcagatgccatttcaatgggtagtgagggcatgagattttctctccagtcgcgtgagatcattgcagacagcgtcgagaccgtgacttgtgcgcagtatcatgatgcatgcattgctattcctgggtgcgacaagaatatgcctggagtggtgatgggtatggcgagacacaatcggccttcgcttatgatttacggtggaacaattcaaattggatactcgaacctgctgcgaaagcgggtcaacgtgtcaacttgctttgaagcggctggtgcctatgcctacgatactttgcgtcaaccggacgatgggggtgacaccagtaaaagcaaggacgagattatggatgacattgagagacatgcttgtcccagtgcgggcgcatgtggaggcatgtttactgcaaacacaatggccacggcgattgagtccatgggcctgtccctaccagggtcatcatcaacgcctgcctcgtctccatcgaagatgcgagaatgtgttaaagcggcagaagccatcaagatctgtatggagaagaacattaagcctcgggatcttttgaccaagcgctccttcgagaacgccctcgtcatgacgatggctctgggaggaagtaccaatggtgtcttgcacttccttgccatggctcggacggcggatgtgaacctgaccctagatgatatacaacgggtcagcaacaagatcccattcattgctgacttggcccccagtgggaagtactacatggcagacctgtacgatattggagggatcccgtctgtgcagaagttgctgatcgcagcgggccttcttgacggcgacatccccacggtcaccggcaagaccttggctgagaatgttgcatctttcccatctctacctcaggaccaagtcatcatccgccccctggacaacccaatcaagacgactggccacctgcagattctacgtggaaacctggcgcctggtggagcggtggccaagatcactggcaaggagggcaccaagttcacaggcaaagcacgtgttttcaataaagaatttcagctcaacgatgctctgacccaaggcaagattcctcgaggcgaaaacctggtgctcatcgtccgctacgaaggacccaagggtggaccaggcatgccggagcagctcaaagcgagtgcggcgctgatgggagctaagctcaacaatgtggccctaatcacagatggaagatattcaggggctagtcatggattcatcgtgggtcatatcgtcccagaagctgcggccggaggacccattgccattgttcgcgatgatgatgtgattaccatcgatgcggaaaccaacacaataaacatgcatgtctcagatgaggaaatccagcagcgactgaaagagtggaagcccccagtgcctcatgtcacacgtggtgtactcgccaagtatgcaaggctggttggggacgcctctcatggtgcaatgacggatctgttctag

SEQ ID NO: 648 - protein, 608 aa, Neosartorya fischeri
MDSSTSTSSNTQGEAKYINFPSLPDDAKHEDGTPALNRYSSYITRSHDFPGARAMLFAAGIPDREAMAKSPQVGIASVWWEGNPCNMHLLDLGKTVKKAVTDQGMTGWQYNTIGVSDAISMGSEGMRFSLQSREIIADSVETVTCAQYHDACIAIPGCDKNMPGVVMGMARHNRPSLMIYGGTIQIGYSNLLRKRVNVSTCFEAAGAYAYDTLRQPDDGGDTSKSKDEIMDDIERHACPSAGACGGMFTANTMATAIESMGLSLPGSSSTPASSPSKMRECVKAAEAIKICMEKNIKPRDLLTKRSFENALVMTMALGGSTNGVLHFLAMARTADVNLTLDDIQRVSNKIPFIADLAPSGKYYMADLYDIGGIPSVQKLLIAAGLLDGDIPTVTGKTLAENVASFPSLPQDQVIIRPLDNPIKTTGHLQILRGNLAPGGAVAKITGKEGTKFTGKARVFNKEFQLNDALTQGKIPRGENLVLIVRYEGPKGGPGMPEQLKASAALMGAKLNNVALITDGRYSGASHGFIVGHIVPEAAAGGPIAIVRDDDVITIDAETNTINMHVSDEEIQQRLKEWKPPVPHVTRGVLAKYARLVGDASHGAMTDLF

SEQ ID NO: 649 - DNA, 1827 bp, Aspergillus oryzae
atggatccctccaaccccgccgtctccgcaacctttggggaagcgaaatacatcgaattcccctgtcttccagaggggacgaagcatgaggatggaacacctgcactgaatcgctactctgcaaccatcactagaggccatgacttccctggcgctaaggcaatgctctatgcagcaggtgttcccgaccaaaacgctatggcaaagagtcctcaggtaggagttgcatctgtgtggtgggaaggaaatccgtgtaacatgcacctgctggatatgggcaagacggtaaagaaggccgtcgagggccagggcatgattggttggcaatataacaccattggtgtttcagatgccatcaccatgggcagtgaaggcatgcggttttctctccaaacgcgtgagatcattgcagatagtgtcgagactgtgacttgtgctcagtaccacgatgcctgcattgccatccccggatgcgacaagaacatgcctggagtggtgatgggtatggccaggcataaccggccctccatcatgatctacggcgggactattcagattgggtattccaacctcctacgaaagccaattaacgtttcgagttgcttcgaagccgctggggcttactcatatgatactttgcgtcaaccggacgacggtggagacaccagcaagaccaaggatgagatcatggatgatcttgaaagacatgcctgtcccagcgcgggcgcatgtggaggcatgttcactgcgaacacaatggccacagctatcgagtcgatgggtctgtctttgcctggctcctcttccacccccgctacatctccatcaaaaatgcgagagtgtgtcaaggtggcggaagcgattaaagtttgcatggagaagaatataagaccgcgtgatcttttgactaagcggtcattcgaaaatgccctcgtcatgacgatggctcttggaggaagcaccaacggtgtgctccacttccttgccatggctcggacagctggcgtggaacttactttagatgatattcaaagggtcagtaacaagatcccattcattgctgacctttcccccagtggaaaatactacatggcggacttgtacgatattggcggggtaccgtctgtccaaaagctgttgattgcagggggcctgcttgatggcgatattccaacagttaccggaaagactctggccgagaacgtggcatcattcccatcgttaccggacgatcaggttattattcgtcctttggacaaccctattaaggcgactggccaccttcagatcctccgtggaaacctagcccccggaggcgctgtggccaagatcaccggcaaggagggcactaaatttataggaaaggcacgagtgtttgataaggagtatcaactcaatgatgcactcaaccagggtaaaataccccgagatgagaatttagtgatcatcgtccgttatgagggccccaagggcggaccgggaatgccggaacagctcaaggccagcgcggcattgatgggagccaagcttaccaacgtggcactgatcactgatggaagatactcaggggcaagtcatgggttcatcgtcggccatatcgtacccgaagccgcggtaggaggaccaatcgctgttgtccgcgatggggacgtggtcacaattaatgcggaaaccaacgaaattagcatggatgtctcggatgaagaaatccagcaacggctgagagagtggcaacctcccgcaccgcacgttacacgcggtgtgctggccaagtatgctcggctggttggtgacgcttcccacggcgcaatgacggaccttttctag

SEQ ID NO: 650 - protein, 608 aa, Aspergillus oryzae
MDPSNPAVSATFGEAKYIEFPCLPEGTKHEDGTPALNRYSATITRGHDFPGAKAMLYAAGVPDQNAMAKSPQVGVASVWWEGNPCNMHLLDMGKTVKKAVEGQGMIGWQYNTIGVSDAITMGSEGMRFSLQTREIIADSVETVTCAQYHDACIAIPGCDKNMPGVVMGMARHNRPSIMIYGGTIQIGYSNLLRKPINVSSCFEAAGAYSYDTLRQPDDGGDTSKTKDEIMDDLERHACPSAGACGGMFTANTMATAIESMGLSLPGSSSTPATSPSKMRECVKVAEAIKVCMEKNIRPRDLLTKRSFENALVMTMALGGSTNGVLHFLAMARTAGVELTLDDIQRVSNKIPFIADLSPSGKYYMADLYDIGGVPSVQKLLIAGGLLDGDIPTVTGKTLAENVASFPSLPDDQVIIRPLDNPIKATGHLQILRGNLAPGGAVAKITGKEGTKFIGKARVFDKEYQLNDALNQGKIPRDENLVIIVRYEGPKGGPGMPEQLKASAALMGAKLTNVALITDGRYSGASHGFIVGHIVPEAAVGGPIAVVRDGDVVTINAETNEISMDVSDEEIQQRLREWQPPAPHVTRGVLAKYARLVGDASHGAMTDLF

SEQ ID NO: 651 - DNA, 1827 bp, Aspergillus niger
atggaccccgccaaacctgccgtgtcatccactttgggggaggccaagtaccttgaatttccctgcgtaccagagggcacaaaacacgaagatggtacccccgtcttgaaccgttggtcttctactatcaccaggggccatgagttccctggcgcgaaggctatgctctacgcggcaggcatccccgatcacaatgccatgacgaagagtccccaggttggtgttgcgtctgtgtggtgggaaggcaacccttgcaacatgcacttgttggacctggccaagacggtgaagaaggcgatcacggaccaaggcatgatcgggtggcagtacaatactattggtgtgtcggatgcgattggcatggggagtgaaggtatgcgattttctctccaaacccgtgagatcattgcagacagtgtggagtctgtaacgtgcgctcaataccatgacgcctgcattgccatccccggatgcgacaagaacatgcctggtgtggtgatgggtatggcgagacacaatcggccctcgatcatgctctacggtggtactatcgaggttgggtattcccagcttcttcggaagcgggtaagcgtttcgacgtgcttcgaagcggctggtgcctacacatataacactctccgtcagccggatgacggaggtgataccagcaagaccaaggacgagatcatggatgatctggagaggcatgcctgcccgagcgcgggagcgtgtggtggtatgttcacggccaacaccatggctacggccattgagtccatgggtctctccttgcccggctcgtcttctacgcctgcatcttccccaactaagatgcgtgagtgtgtcaaggcagctgaagccatcaagatttgcatggagaagaacatccgtcctcgggatctgttgaccaagcgggcgttcgagaatgccctggtcatgactatggccctgggaggtagcaccaatggtgtgcttcacttcctggctatggcccgcactgccggcgtggaccttactctggacgacgttcagcgggtcagcaacaagatccctttcattgcggacctgtcccctagtgggaaatactacatggcggacctctacgaagtcggaggcatcccgtcggttcagaagttgttgatcgcagctggtctgctcgacggcgatatccccaccgtgaccggcaaaactctggcccagaacgtcgcatcgcacccatctctgtctgctgaccaggtcatcatccgtcccctggataaccctatcaaggcgacgggccacctccagatcctgcgaggtaaccttgcacccggtggtgcggttgctaagattaccggcaaggaagggctccggttcacgggtaaggcgcgcgtgtttgacaaggagcatcagctcaacgaggccctgaaccagggcaagatccctcacggcgagaacctggttatcgtagttcgttacgagggcccgaagggtggcccgggaatgccggaacaactgaaggccagtgcagcgctcatgggagccaagctcaccaacgtggcactgattacggacgggcggtactctggcgctagtcacggattcattgtggggcatattgtccctgaagctgctgtaggaggacccattgccgttgttcgggacggcgatgtgatcacaattgatgccgaatcgaacgccatcaccatggatgtatcggatgaggaggtgcagcagcgtctgcgggagtggaagcccccggcaccgcatgtcacacgaggtgtgctggccaaatatgcccggttggtgggagatgcctcgaacggagccatgacggatctattttag

SEQ ID NO: 652 - protein, 608 aa, Aspergillus niger
MDPAKPAVSSTLGEAKYLEFPCVPEGTKHEDGTPVLNRWSSTITRGHEFPGAKAMLYAAGIPDHNAMTKSPQVGVASVWWEGNPCNMHLLDLAKTVKKAITDQGMIGWQYNTIGVSDAIGMGSEGMRFSLQTREIIADSVESVTCAQYHDACIAIPGCDKNMPGVVMGMARHNRPSIMLYGGTIEVGYSQLLRKRVSVSTCFEAAGAYTYNTLRQPDDGGDTSKTKDEIMDDLERHACPSAGACGGMFTANTMATAIESMGLSLPGSSSTPASSPTKMRECVKAAEAIKICMEKNIRPRDLLTKRAFENALVMTMALGGSTNGVLHFLAMARTAGVDLTLDDVQRVSNKIPFIADLSPSGKYYMADLYEVGGIPSVQKLLIAAGLLDGDIPTVTGKTLAQNVASHPSLSADQVIIRPLDNPIKATGHLQILRGNLAPGGAVAKITGKEGLRFTGKARVFDKEHQLNEALNQGKIPHGENLVIVVRYEGPKGGPGMPEQLKASAALMGAKLTNVALITDGRYSGASHGFIVGHIVPEAAVGGPIAVVRDGDVITIDAESNAITMDVSDEEVQQRLREWKPPAPHVTRGVLAKYARLVGDASNGAMTDLF

SEQ ID NO: 653 - DNA, 1773 bp, Aspergillus terreus
atggacccctcgactcccgccgtgtcgtccaccatgggcgaggccaaatacatcgaatttcccagtctccccgacgacgcaaaacaccccgatggcacccccgcgctgaaccgctactcaacaaccatcacgagaggccatgactttcccggtgcgaaggccatgctgtatgcggccggcatcccggaccaggaaaccatggccaaagcgccgcacgtcggaatcgcctcggtctggtgggaggggaacccgtgcaacatgcacctgttagatctgggaaagacggtgaagaagtcggtggacgcacagggcatgatcggatggcagtacaacaccattggtgtgtcggacgccattaccatgggcagcgagggaatgcgcttctcgctgcagtcccgcgagatcatcgcggacagcgtcgagacagtcacctgcgcgcagtaccacgacgcgtgcatcgccatccccggctgcgacaagaacatgccgggcgtggtgatgggcatggcgcggcacaatcggccgtcgatcatgatctacggcggcacgatccagatcggctactccaacctgctacgcaagccgatcaacgtgtcgacgtgctttgaggcggcgggcgcctatgcctacgacacgctgcggcagccggacgacggcggcgacacgagcaagaccaaggacgagatcatggacgagctggagcagcacgcgtgcccgagcgcgggcgcgtgcggcggcatgttcacggccaacacgatggcgacggcgatcgagtcgatggggctgtcgctgcccgggtcgtcgtcgacgccggcgtcgtcgccggccaagatgcgcgagtgcgccaaggccgccgacgccatcaagcggtgtctggcgctgaacctccggccgcgcgacctgctcaccaagcgcgcggggcgcccccccgggggtggccccccccctttgagggacatcccagggggtgaggcgaccgcattcccttcattggccaccttttggcccaaggggcaaagttactccatgggcagatctgttcggagattcgggggcgtgcggtccgtgcaggaggttgtttattcgcagccggcctgcttgacggcgccatccccacggtcacgggcaagacccctcgccggagaacgtggcctcggtggccgtccctgcccgccgacccaggtcatcatccgcccgctcgacaaccccatcaagccgacgagccatctgcagattctgcgcggcaacctggcccccggcggcgccgtcgccaagatcaccggcaaggagggcacgcgcttctcgggcaaggccctcgtcttcgacaaggagtaccagctcaacgacgccctgaaccagggccagattccccgcggcgagaacatcgtcatcgtcgtccgctacgagggccccaagggcgggcccggcatgcccgagcaactcaaggcgagcgccgccctgatgggtgcgaagctcaccaatgtggccctgatcaccgatggtcggtactcgggcgcgagccatggcttcatcgtcggccatattgtccccgaggccgcggtgggtggccccattgcggtcgtccgcagcggtgatgtgatcacgattaatgcggaaaccaacgagatcaccatggatgtctcggacgaagagatccagcagcgtctgaaggagtggaagcccccagcacctcatgtcacgcggggcgtgttggccaagtatgcccggttggtgggagatgcttcgcacggtgccatgaccgacctgttttag

SEQ ID NO: 654 - protein, 590 aa, Aspergillus terreus
MDPSTPAVSSTMGEAKYIEFPSLPDDAKHPDGTPALNRYSTTITRGHDFPGAKAMLYAAGIPDQETMAKAPHVGIASVWWEGNPCNMHLLDLGKTVKKSVDAQGMIGWQYNTIGVSDAITMGSEGMRFSLQSREIIADSVETVTCAQYHDACIAIPGCDKNMPGVVMGMARHNRPSIMIYGGTIQIGYSNLLRKPINVSTCFEAAGAYAYDTLRQPDDGGDTSKTKDEIMDELEQHACPSAGACGGMFTANTMATAIESMGLSLPGSSSTPASSPAKMRECAKAADAIKRCLALNLRPRDLLTKRAGRPPGGGPPPLRDIPGGEATAFPSLATFWPKGQSYSMGRSVRRFGGVRSVQEVVYSQPACLTAPSPRSRARPLAGERGLGGRPCPPTQVIIRPLDNPIKPTSHLQILRGNLAPGGAVAKITGKEGTRFSGKALVFDKEYQLNDALNQGQIPRGENIVIVVRYEGPKGGPGMPEQLKASAALMGAKLTNVALITDGRYSGASHGFIVGHIVPEAAVGGPIAVVRSGDVITINAETNEITMDVSDEEIQQRLKEWKPPAPHVTRGVLAKYARLVGDASHGAMTDLF

SEQ ID NO: 655 - DNA, 1827 bp, Coccidioides immitis
atggcttctcaagctcctattgcgcaagatggaccaaacgaggaggcgaaatatatcgacttcccctgtcttcctgatgatgcgatgcgggacggaaaaccggccttgaacaaatattctcagttcattacaaaaggtcatgattacccaggtgcccaggcaatgttatatgctgctggggtacctgatagggatgccatgaaaacgagtcctcatgttggcattgcatcagtatggtgggaaggaaatccctgcaacatgcacttgttggatttaggaaagactgtgaaaaaggctgttatagatcagggcatgctgggatggcaatacaataccattggtgtctctgacgcaatcacaatgggtcatgaaggcatgcgcttttctctgcagtctcgtgagatcattgccgacagcatcgaaactgtgacttgcgcacaataccatgacggttgcattgccatacctggttgtgacaagaacatgcctgggtgtattatggccatgggaagacacaaccgcccctccctgatgatatacggtggtacaattcaaggcggatattcgaaactattgcgacgacccattaacgtttcgacctgctatgaggccgcgggtgcttatgcgtataatactttagtccagccggacgatgggggggacaggagcaaaactaaggatgagatcatggaagacattgaaagacatgcttgtccgagcgctggggcttgcgcaggcatgtatactgcgaacacaatggccacagcaattgagtcgatgggtctgactctgcctggttcatcttctacccccgcaacatcaccagcgaagatgcgagaatgtgtaaaagcggctgatgcaattaaattgtgcatggagaggaacatcagaccgcgcgacttattgacaaaacggtcctttgagaatgccctggtcatgacaatggctctcggtggaagcactaacggcgttgttcatttcattgccatggctagatcggctggtgttcacttaatgctagatgacatccagcgtgttagtgacaaaattccttttatcgcgaacctcgccccaagcggaaaatattacatggcagatctatacgaaattggaggcattccatccgtccagaaattgcttgtcgccgcaggccttttagatggcggtattcccacggtgactggaaagacattggcggagaacattgcatctttcccctccctcccacaagaccaagctatcattcacccacttgacaacccgatcaagtcaaccggccatctccaggtgctcaggggaaaccttgcccctggcggtgctgtcgctaaaattaccggaaaagaaggtactaaatttacgggaaaggctcgcgtatttaacaaagagcacgagttggacgccgctctaagccgtggcgagattccacgcggagataacctcgtcctcgtcgttcgatatgagggaccaaagggtggtcccggaatgccggaacaactcaaagctagtgctgccttgatgggagctaaactcacaaacgtagcgctgattacagatggcagatattcaggtgccagtcatggatttattgttggacacattgtcccagaagctgcagtgggcggtccgattgctgttgtgcaggatggtgatacgatcacaatcaacgcggataccaacgaactcacaatggatgtttctgacgaagaaatcgcacagcgtttgaaggggtggaaaccgccaaaaccacgtgttacccggggggtgctggcgaagtatgctaaattagtcggagatgcatcaaatggtgctatgactgaccagttttag

SEQ ID NO: 656 - protein, 608 aa, Coccidioides immitis
MASQAPIAQDGPNEEAKYIDFPCLPDDAMRDGKPALNKYSQFITKGHDYPGAQAMLYAAGVPDRDAMKTSPHVGIASVWWEGNPCNMHLLDLGKTVKKAVIDQGMLGWQYNTIGVSDAITMGHEGMRFSLQSREIIADSIETVTCAQYHDGCIAIPGCDKNMPGCIMAMGRHNRPSLMIYGGTIQGGYSKLLRRPINVSTCYEAAGAYAYNTLVQPDDGGDRSKTKDEIMEDIERHACPSAGACAGMYTANTMATAIESMGLTLPGSSSTPATSPAKMRECVKAADAIKLCMERNIRPRDLLTKRSFENALVMTMALGGSTNGVVHFIAMARSAGVHLMLDDIQRVSDKIPFIANLAPSGKYYMADLYEIGGIPSVQKLLVAAGLLDGGIPTVTGKTLAENIASFPSLPQDQAIIHPLDNPIKSTGHLQVLRGNLAPGGAVAKITGKEGTKFTGKARVFNKEHELDAALSRGEIPRGDNLVLVVRYEGPKGGPGMPEQLKASAALMGAKLTNVALITDGRYSGASHGFIVGHIVPEAAVGGPIAVVQDGDTITINADTNELTMDVSDEEIAQRLKGWKPPKPRVTRGVLAKYAKLVGDASNGAMTDQF

SEQ ID NO: 657 - DNA, 1788 bp, Paracoccidioides brasiliensis
atgaatcccgaagagaaggtcgatggcttcgaagagccgcgatacatccagttcccttgcctgccggacgatgcgactcgggatggaaagccggtgttgaataaatattctacatttcttacagcgatgttatatggcgcgggggtgccggatcgtgagagcatgaaaaatagcccccaggtcggcattgcgacggtatggtgggaagggaatgcctgtaatatgcaccttttggatctggggaagacggtcaaaaaagccatcacggatcaggggatgctgggctggcaatataacaccatcggtgtctccgatgctatttccatgggtagtgaaggtatgcgatactccctccaatctcgggagatcattgcagacagcatcgagacagtagtaggtgctcaatatcatgatgctgcattgcgattccgttgcgacaagaacatgccaggctgcgtcatgggtatggccagacataacagaccgtctttgatgatatacggtgggacaattcaggtcgggtactccaagttactccgcaggcgaatcaacgtctctacttgctacgaagcagctggcgcgtacgcttacaacaccttaacccagcccgacgacggcggagaccgctcgaggacgaaagatgaaatcatggaagacattgagcgaaatgcctgtcccagcgctggcgcatgcgcgggaatgtacacagcaaacaccctggctaccgcgattgagtcaatgggtttgactctgccaggctcctcgtccaccccagctacggtgcctgccaagatgcgcgagtgcgtaaaagcagcggacgcgatcagaatatgtatggagaagaacattaggccgcgagatctacttacgaaacgctcctttgagaatgcgctggtaataaccatggcgctgggcgggagcacgaacagcatcgttcacctgatagcgatggccagaacggcccgggttgaattaacactcgatgattcccagcgtgtgagcgacaaaatcccgtttattgttgacttggcacccagtgggaaatactacatggcagacctttatgaaattggcgggattccatctgtgcagaagctgttgattgccgcaggcttgatggacggtgacatccccacagtaactggcaaaacgctagcagagaacatccaatccttcccctccctcccacaggaccaggccatcatccacccgctagccaaccccatcaagagcacgggccatatacaaatattgaaaggcaacctcgcccccggcggcgccgtagccaaaatcacaggcaaagaaggcaccaaattcaccggcaaagccctcgttttcaacaaagaacacgagcttgacgaagcgcttaacaagggcctaataccccgcggcgaaaacctagtgctaatagttcgctacgagggtccgaagggtggccccggcatgcccgagcagctgaaggccagcgcagcgctgatgggcgccaaactgacgaatgtcgcgctaattacggacgggaggtattcgggggccagtcatgggtttattgtcgggcatattgtgcctgaggcggcggttggggggcccattgctgttgtgcacaatggggatatgattacgattgatgcggagagaaatgagattagtatggcggtttcggaggaggaggttgcggagaggttgaaggagtggaggccgccgaagccgcatgtgactagggggacgttggccaagtatgcgagacttgttggagacgcgtcgcatggggctatgacggatatgttttga

SEQ ID NO: 658 - protein, 595 aa, Paracoccidioides brasiliensis
MNPEEKVDGFEEPRYIQFPCLPDDATRDGKPVLNKYSTFLTAMLYGAGVPDRESMKNSPQVGIATVWWEGNACNMHLLDLGKTVKKAITDQGMLGWQYNTIGVSDAISMGSEGMRYSLQSREIIADSIETVVGAQYHDAALRFRCDKNMPGCVMGMARHNRPSLMIYGGTIQVGYSKLLRRRINVSTCYEAAGAYAYNTLTQPDDGGDRSRTKDEIMEDIERNACPSAGACAGMYTANTLATAIESMGLTLPGSSSTPATVPAKMRECVKAADAIRICMEKNIRPRDLLTKRSFENALVITMALGGSTNSIVHLIAMARTARVELTLDDSQRVSDKIPFIVDLAPSGKYYMADLYEIGGIPSVQKLLIAAGLMDGDIPTVTGKTLAENIQSFPSLPQDQAIIHPLANPIKSTGHIQILKGNLAPGGAVAKITGKEGTKFTGKALVFNKEHELDEALNKGLIPRGENLVLIVRYEGPKGGPGMPEQLKASAALMGAKLTNVALITDGRYSGASHGFIVGHIVPEAAVGGPIAVVHNGDMITIDAERNEISMAVSEEEVAERLKEWRPPKPHVTRGTLAKYARLVGDASHGAMTDMF

SEQ ID NO: 659 - DNA, 1635 bp, Phaeosphaeria nodorum
atggatccgcgcaaccttgaaaagcagcgagagccagaggagccgcgcttcctcacgttcccgcatctgccagaggatgccatgcgagatggcaagcctgcgttgaacaaatactcgtctactcttactgctggccataactttccgggagctcaggccatgctttatgcggctggtgttccctcgaaggaagccatgaagacacagcctcacgtaggcattgcgagtgtatggtgggaaggcaacccatgcaaaactgcagtgctcgacctgggaaaggagattaagaaaaacgtccaggctgacaatatgctggcatggcagtacaacactgtgggcgtgtcggatggtattacgatgggtggagagggcatgcgcttctctctgcagactcgcgagataatagcagacagtattgagacggtcacgtgcgcgcaacatcacgacgcgtgtattgccattcccggatgcgacaagaatatgcctggtgtcatcatggcatttgcccgtcacaaccgaccatcgataatggtatatggcggctccataatgccaggctattccgagacgctcaagaagcccatcaacatttcaacatgctacgagaaacacggtgcctatatctacaagaatctggagagtgctgaaaaggggaaattttcgccagaggaaatcatggatgacattgagcgcaatgcatgcccgggtgctggcgcatgtggcggcatgtacactgccaacactatgtccacgtccattgaggccaagatgcgcgaatgtgccaaagctgcagctgccatccgcgtctgcatggaaaagaacatcacgccccggaaactactcaccaaggcctccttcgagaatgccctcgtcatgatgatggtcctcggcggctcgaccaacgccgtcctgcacatgctcgccatggccggtacagcaggcgtccccttaacccttgacgacttccagcgcgtgtccaacaaaattcccttcctcgccgacctcgccccctctggccgctacatggctgccgacctctttgacattggcggcatgccctccgtcatgaagctcctcgtcgccgcgggcctccttgacggtagcatccccaccgttaccggcaagaccctcgcagaaaacatcgagccctacccttccttgccgcaagatcaggtcctcatccgccccctctccaaccccatcaaagccaccggccacatcgagatcctacgcggcaacctcgcgcccgccggcgccgtggcgaaaatcacggggaaagagggcttgatattccgcggtagggcgatggtatttgacaaggaacaccagcttgacaaggcgctgaatgaaggtcgtattccgcatggcgagaatatcgtcgttgtcgtgcgctacgagggaccgaagggtggcccgggtatgcccgagcaactcaaagccagcgcggcgattatgggcgcgaaactcaccaacgtcgcgctaattacggatgggcggtatagtggtgccagtcacgggtttattgtcgggcacatgtgtccagaagcggccgtgggtggccccattgctgtggttagggatggggatgttatcactattggtaagtcgtgttgcaaagtcggagagagatggtga

SEQ ID NO: 660 - protein, 544 aa, Phaeosphaeria nodorum
MDPRNLEKQREPEEPRFLTFPHLPEDAMRDGKPALNKYSSTLTAGHNFPGAQAMLYAAGVPSKEAMKTQPHVGIASVWWEGNPCKTAVLDLGKEIKKNVQADNMLAWQYNTVGVSDGITMGGEGMRFSLQTREIIADSIETVTCAQHHDACIAIPGCDKNMPGVIMAFARHNRPSIMVYGGSIMPGYSETLKKPINISTCYEKHGAYIYKNLESAEKGKFSPEEIMDDIERNACPGAGACGGMYTANTMSTSIEAKMRECAKAAAAIRVCMEKNITPRKLLTKASFENALVMMMVLGGSTNAVLHMLAMAGTAGVPLTLDDFQRVSNKIPFLADLAPSGRYMAADLFDIGGMPSVMKLLVAAGLLDGSIPTVTGKTLAENIEPYPSLPQDQVLIRPLSNPIKATGHIEILRGNLAPAGAVAKITGKEGLIFRGRAMVFDKEHQLDKALNEGRIPHGENIVVVVRYEGPKGGPGMPEQLKASAAIMGAKLTNVALITDGRYSGASHGFIVGHMCPEAAVGGPIAVVRDGDVITIGKSCCKVGERW

SEQ ID NO: 661 - DNA, 1803 bp, Gibberella zeae
atggcggaccaagtcactcacgatcccaagcagtcaagcgactacatccccttcccttgccttcctcccggcggagctctcaaccgttggtctacaaagatcacccgcgagcatgactaccccggagctcaggctatgctctacggagctggtgtcaaggaccagcacacaatgaagaacgcgccccaggttggtgttgctaccgtctggtggcaaggaaacccgtgcaatacccatctccttgatcttggccagatcgtcaagaactccatcgagaaggaaggcatgatcggctggcagttcaacaccgttggtgtatctgacgccatcaccatgggcggcgagggcatgcgcttctctcttcaaactcgagaaatcattgctgattctatcgagtccgtaacctgcgcccagcatcatgacgccaacatctccattcccggctgtgacaagaacatgcccggcacagtcatggccgccgctcgtcacaaccgccccttcatcatgatctacggcggtaccatccgcaagggccactccaacctccttgagaagcccatcaacatcagcacctgctacgaggcctcgggtgctttcaactacggtcgtctgcatgccaagacgaaccccggcgagcctggtcgcgagagctccgatgtcatggatgatatcgagaagcacgcttgtcccggcgccggagcttgtggtggcatgtatacagccaacaccatggctaccgctatcgaggccatgggccttactctgcctggttcatcatcgtaccctgccgagtctcctgagaagcgtcgtgagtgtgagcgcgctgcccaggttatccgaactaccatggagaaggaccttcgtcctcgcgatatcatgacccgtgcctctttcgagaacgctcttgtcctgaccatgattctcggtggttcaacaaacggtgttcttcacttcctcgccatggccaacaccgccgatgttcccctgaccattgacgacatccagcgtgccagtgaccgcacccccttcctcgctgatctcgcccccagtggaaagtactacatggaggatctctacaaggtcggcggtacaccctccgtcatcaagatgctcgtcgcccgtggtcttctcgacggtagcatcatgaccattaccggcaagactctcgccgagaacgtcgcggactggcctagtctggaccccggccaggacatcatccgtcctcttgagaaccccatcaaggactctggccacatccgcatcctaaagggtaactttgcccccggcggcgccgtcgctaagatcactggaaaggagggtctgtccttcaccggcaaggcccgtgtcttcaacaccgagaaggagctcaacggcgcactgaaccgaagcgagatcaagcagtccgatggtaacctcgtcgtcatcgtccgatacgagggccccaagggcggtcccggtatgcctgaacagctcaaggcttctgcagccatcatgggtgccggcctctccaacctggcacttgtcaccgacggacgatacagtggtgcttctcacggtttcatcgtgggccacgttgtgcctgaggctatggtcggaggtcccatcgctctggtcaaggatggagacgagatcactatcgatgcgattaacaaccgaatcgatgtcgacatcactgacgaggagatggagaagcgaaggagtgagtggaagcctcctgcgccccgtgttacgaggggtgtgttggccaagtatgcccgcttggtcggtgatgcttcccacggtgctgtaacagatcagtggtag

SEQ ID NO: 662 - protein, 600 aa, Gibberella zeae
MADQVTHDPKQSSDYIPFPCLPPGGALNRWSTKITREHDYPGAQAMLYGAGVKDQHTMKNAPQVGVATVWWQGNPCNTHLLDLGQIVKNSIEKEGMIGWQFNTVGVSDAITMGGEGMRFSLQTREIIADSIESVTCAQHHDANISIPGCDKNMPGTVMAAARHNRPFIMIYGGTIRKGHSNLLEKPINISTCYEASGAFNYGRLHAKTNPGEPGRESSDVMDDIEKHACPGAGACGGMYTANTMATAIEAMGLTLPGSSSYPAESPEKRRECERAAQVIRTTMEKDLRPRDIMTRASFENALVLTMILGGSTNGVLHFLAMANTADVPLTIDDIQRASDRTPFLADLAPSGKYYMEDLYKVGGTPSVIKMLVARGLLDGSIMTITGKTLAENVADWPSLDPGQDIIRPLENPIKDSGHIRILKGNFAPGGAVAKITGKEGLSFTGKARVFNTEKELNGALNRSEIKQSDGNLVVIVRYEGPKGGPGMPEQLKASAAIMGAGLSNLALVTDGRYSGASHGFIVGHVVPEAMVGGPIALVKDGDEITIDAINNRIDVDITDEEMEKRRSEWKPPAPRVTRGVLAKYARLVGDASHGAVTDQW

SEQ ID NO: 663 - DNA, 1923 bp, Neurospora crassa
atggcttccaaccaagataataaggctgtcgctcccgacgccgccgctcccgccggccagtccaccaccaccacgaccaccaacgacaacagcgagcgcaacttgcccaaagagggcgaatacatccaatggcgtactctcccagctggcaaccccgaccagttgaaccgctggtcgcactttttgactcgtgagcatgagtttcctggagctcaggccatgctctacggcgccggtgtcccgaataaggacatgatgaagaaggcgccgcatgtcggcattgcgacggtctggtgggagggcaacccctgcaacacccatttgctggatcttggccaaaaggtcaagaaggccgttgagcgcgagaagatgcttgcgtggcagttcaacaccattggtgtctcggatggtatcaccatgggcggagagggcatgcgctactcgcttcagtctcgcgagatcatcgccgactccatcgagaccgtgacgtgcgctcagcatcatgacgccaacatctccattcccggctgcgacaagaacatgcccggtgtcatcatggccgcggcccgccacaaccgtcccttcgtcatgatctacggcggcaccatgcgcggcggccactcggagctcctcgaccgccccatcaacatcgtcacttgctacgaggcttccggcgcttacacgtatggccgtctcaagcccgcttgccccaacagcaccgccaccccttcggacgtcatggacgacatcgagcagcacgcctgccccggcgccggcgcctgcggcggcatgtacaccgccaacaccatggcgaccgccatcgaagccatgggcctcaccgcaccgggctcctcttctttccctgcctcttcgcccgaaaagttccgcgagtgcgaaaaagccgccgagtacatcaagatctgtatggagaaggacattcgcccgcgcgacctcttgaccaaggcctcgttcgagaacgccctcgtgctcaccatgatcctcggcggttctaccaatggcgttctgcactacctcgccatggccaactcggccgacgtcgacttgactctggacgacatcaaccgcgtctcagccaagacgccctttttggctgacatggccccctccggcaggtactacatggaagacctgtacaaagtcggcggcacccccgcggtcctcaagatgctcatcgccgcaggctatatcgatggcaccatccccactatcaccggcaagtctttggcggaaaacgtatccgactggcctagtctcgaccccgatcaaaaaatcatccgcccccttgacaaccccatcaagtcccaggggcatatccgtgtcttgtacggaaacttctcccccggtggtgcggtcgccaagattacaggcaaggaaggtctctccttcaccggcaaagcccgttgtttcaacaaggaattcgagctcgacgccgccttgaagaactcggaaattaccctcgagcaaggaaaccaggtcctcatcgtgcggtacgaaggacccaaaggcggtccaggtatgccagagcaactgaaggcttcagcggcgatcatgggcgcgggcctgacgaatgtcgcgctggtgacggatggtcggtactctggtgcgtcgcatgggtttattgtgggccatgtggtccccgaggcggcgacgggggggccgattgcgctggtgaaggacggggatttgattacgattgatgcggttaggaaccggattgatgtcgtcaagactgtggaaggcgtcgagggtgaggaagagattgccaaggtgttggaggagagaaagaaggggtggaaggcgccgaagatgaagccgacgaggggggcgttggccaagtatgcgaggttggtgggggatgcgtcgcatggggctgttactgatttgggtggggatgcctattag

SEQ ID NO: 664 - protein, 640 aa, Neurospora crassa
MASNQDNKAVAPDAAAPAGQSTTTTTTNDNSERNLPKEGEYIQWRTLPAGNPDQLNRWSHFLTREHEFPGAQAMLYGAGVPNKDMMKKAPHVGIATVWWEGNPCNTHLLDLGQKVKKAVEREKMLAWQFNTIGVSDGITMGGEGMRYSLQSREIIADSIETVTCAQHHDANISIPGCDKNMPGVIMAAARHNRPFVMIYGGTMRGGHSELLDRPINIVTCYEASGAYTYGRLKPACPNSTATPSDVMDDIEQHACPGAGACGGMYTANTMATAIEAMGLTAPGSSSFPASSPEKFRECEKAAEYIKICMEKDIRPRDLLTKASFENALVLTMILGGSTNGVLHYLAMANSADVDLTLDDINRVSAKTPFLADMAPSGRYYMEDLYKVGGTPAVLKMLIAAGYIDGTIPTITGKSLAENVSDWPSLDPDQKIIRPLDNPIKSQGHIRVLYGNFSPGGAVAKITGKEGLSFTGKARCFNKEFELDAALKNSEITLEQGNQVLIVRYEGPKGGPGMPEQLKASAAIMGAGLTNVALVTDGRYSGASHGFIVGHVVPEAATGGPIALVKDGDLITIDAVRNRIDVVKTVEGVEGEEEIAKVLEERKKGWKAPKMKPTRGALAKYARLVGDASHGAVTDLGGDAY

SEQ ID NO: 665 - DNA, 1575 bp, Coprinopsis cinerea
atggataaaccccagatcggtatttcgccggtctggtgggaaggcaatccatgcaatttccacctccttgaccttgcaaagcatgtcaagaaaggctgtcaagaagaagaccagattgggttgatctttaataccatcggtgtcagtgatgccattacgatgggtacagacggaatgcggtacagtctacccagtcgagacctcatcgcggactccatcgaagcagtcgtcatggcccagcactacgacggaaacatcgctattcctggatgcgacaagaacatgcccggctgcttcatggctgctgtccgacacaaccgaccgaccattatcgtctatggagggactatccaacctggtacccggcacgttggtgcctttactgtgggcaagatcaccgatgagcagaggttcgacgttgtgcgacatgcctgtcctggccccggagcctgcggcggaatgtacactgcgaacacgatgagttctgccctcgaggtcctcggcttgtcgctcccgtattcttcaagtatcccagcgatgcatccagagaaggtccaagaatgcttcagggctgccaagtacatgaagaagctgcttgagttggatttgaagcccagggatatcttgacgaagcagtccttcctgaatgccattgtcatcatcaccgttctgggaggctccacgaacgcggttctccacttgttggcaatggcccgagctgctgagattgatctcaccatcgacgacttccaagctgtagcagacaggacaccattcctggccgacctcatgccgtcaggtcgctattacatggaagacatccaccgcattggcggcatccccgccatcgtcaagtatttgttgaaccactccgatctcatcgacggaaaccagatgactgtcactggaaagacgctggctgagaacctagcggatgttcctgagcttgagttccataaccaggacgtcttccgtccactggacaatcctatcaagccgacaggtcatatcacgatcttgagaggtaacctggcgccagaaacagctgttgcgaagctcactggcaaagagggactgagattcgagggtgtcgcgcgttgcttcgatagcctcgagaagttctaccccgctcttgctgcaggggaaatcaaacccggaactgtcctaatcttcagatatcaaggtcccaaaggtgcacccggtatgccggagatgttgggtatgagcgctgcatcgcgtggtccaactggagctatcgcaggcgctggcttggccaactcgactgcgttgatcacggacggccgtttctctggcgccagccgagggtttattattgggcacgtcgtcccagaggcacgagttggcggacccattgcccttgtcaaggacggagacaagatcgtcatcgacgccgagactcgaacaatcaactggctcgtggatgaggaagaacaagcaaagaggaggaaagaatgggaggcgtcggataacggcaagttgaatgtgaagagaggagttttgtaccgatatgccagagatgtcgcgcctgcaagcatgggagcatattgtgattga

SEQ ID NO: 666 - protein, 524 aa, Coprinopsis cinerea
MDKPQIGISPVWWEGNPCNFHLLDLAKHVKKGCQEEDQIGLIFNTIGVSDAITMGTDGMRYSLPSRDLIADSIEAVVMAQHYDGNIAIPGCDKNMPGCFMAAVRHNRPTIIVYGGTIQPGTRHVGAFTVGKITDEQRFDVVRHACPGPGACGGMYTANTMSSALEVLGLSLPYSSSIPAMHPEKVQECFRAAKYMKKLLELDLKPRDILTKQSFLNAIVIITVLGGSTNAVLHLLAMARAAEIDLTIDDFQAVADRTPFLADLMPSGRYYMEDIHRIGGIPAIVKYLLNHSDLIDGNQMTVTGKTLAENLADVPELEFHNQDVFRPLDNPIKPTGHITILRGNLAPETAVAKLTGKEGLRFEGVARCFDSLEKFYPALAAGEIKPGTVLIFRYQGPKGAPGMPEMLGMSAASRGPTGAIAGAGLANSTALITDGRFSGASRGFIIGHVVPEARVGGPIALVKDGDKIVIDAETRTINWLVDEEEQAKRRKEWEASDNGKLNVKRGVLYRYARDVAPASMGAYCD

SEQ ID NO: 667 - DNA, 1767 bp, Laccaria bicolor
atgtcagctccgggagacgtttacattcacgatgtcctcaagaaatcgagcctccccgattcgaagttgaacaggatatcctgtcaattaacgcaaaacaagattcggggtggcgctcaggcgatgctttacgctgtcggtttgagtgaggacgatatgaacaagcctcagattgggatttctccagtgtggtgggaagggaacccatgtaactctcaccttcttgaccttgccaagcacgtaaaggaaggttgtaaagcagaggatcttgttggtcttatcttcaataccattggcgtcagcgacgcgattacgatgggaacagatggaatgagatattctctgccaagtcgagatatcattgcagattcaatcgaagctgctcaacattacgacgccaacatctcaataccagggtgtgacaagaacatgccaggttgcttcatcgccgcagtccgtcataatcgaccaacgatcattgtttacggtggaactattcaaccgggcgtccggcatgtcgattgcccttcgatgggcaaggaaaaaggtggatcagtgaatatctctgacgcatttgaatcttatggggcattcgccgttggaaaaattaacgacgtggagcgatttgatgtcgttcgccacgcatgtcctggcgcaggggcttgtggaggcatgtacactgcgaacaccatgagttcagcccttgaggctcttgggatatctttgccctattcatcgagcacgccagccctgtaccccgagaaggttcaagagtgttttcgagcagcaaagtatttaaaacgtttgcttgaattagatctgaagcccaaggacattttgacccgaaactcgtttttaaatgctatcgtcatcataaccgttctcggtggctccacgaatgcagttttgcacttgctagctatggctcgcgcagctgaggtagaactcacaatcgatgacttccaaatgattgcagacaaaacgcctttcctggccgatttaatgccttcagggaggtattatatggaggatatccacaagatcggaggaatccctgccattctgaaatacctattgaaccacaccgatcttatcgatgggacacagatgacggtgaccgggcgtactttggcagaaaacctcgcagatgtacctgagctcgagttcgataagcaagatgttgttcgaagcttgagcaatcctatcaagaaaacgggccatatcacgatcatgcggggaaatctagctccagagacggccgtagccaaactcacagggaaagaaggtctcaaatttgagggaattgcgagatgctttgatagcttggatggattctatccagcgcttgaggcgggtgagatcaaggcaggcacggtgcttatctttaggtatcaaggaccaaaaggtgcacccggtatgcccgagatgcttggtccaacaggagccattgcaggcgctggacttgctcgttccacagccttaataacagatggtcgcttctcaggagccagtcgaggatttatcataggtcacgtcgtgccggaagcccgtgttggaggacctatcgcactcgttaagaatggggaccgaatcgtcattgattccgagacccgaacgatcaactggctggttgatgagaacgaacaaaaactgcgcaaggcagaatgggatgcctcagagaattcgaaattcaatgtcgggcggggtgtacttttgaggtacgctcgagatgtcgcaccggccaaccttggagcatattgcgattga

SEQ ID NO: 668 - protein, 588 aa, Laccaria bicolor
MSAPGDVYIHDVLKKSSLPDSKLNRISCQLTQNKIRGGAQAMLYAVGLSEDDMNKPQIGISPVWWEGNPCNSHLLDLAKHVKEGCKAEDLVGLIFNTIGVSDAITMGTDGMRYSLPSRDIIADSIEAAQHYDANISIPGCDKNMPGCFIAAVRHNRPTIIVYGGTIQPGVRHVDCPSMGKEKGGSVNISDAFESYGAFAVGKINDVERFDVVRHACPGAGACGGMYTANTMSSALEALGISLPYSSSTPALYPEKVQECFRAAKYLKRLLELDLKPKDILTRNSFLNAIVIITVLGGSTNAVLHLLAMARAAEVELTIDDFQMIADKTPFLADLMPSGRYYMEDIHKIGGIPAILKYLLNHTDLIDGTQMTVTGRTLAENLADVPELEFDKQDVVRSLSNPIKKTGHITIMRGNLAPETAVAKLTGKEGLKFEGIARCFDSLDGFYPALEAGEIKAGTVLIFRYQGPKGAPGMPEMLGPTGAIAGAGLARSTALITDGRFSGASRGFIIGHVVPEARVGGPIALVKNGDRIVIDSETRTINWLVDENEQKLRKAEWDASENSKFNVGRGVLLRYARDVAPANLGAYCD

SEQ ID NO: 669 - DNA, 1794 bp, Ustilago maydis
atggtcaacggagaagtcgagctgcgcacaacttcgcgcaccaatggtgacgctcccgccccgatcctgaacaggatcagtcgatacatcacgcaatcctccgacaagggagctgctcaatccatgcttcacgcgtgcggtctttcggtacaagacctcgacaagccccaggttggcatctcatctgtatggtgggaaggcaacccatgcaatactcacctgctcgaatttggccgcaagatcaagcaaggctgcgaagcggaaggtctggtgggcttgcaaaataacacggtgggcgtttccgatgccatcaccatgggcggccccggaatgcagtattcgcttccttcgagagagctgatcgccgactctatcgagacgatcaccctcgcgcagtatcatgacgctaatgtgtccatccccggttgtgacaagaacatgcctggctgtctcattgcttgtctgcgtcacaaccgcccatcaatcatcgtttatggcggcacgatccaacccggcaagcacggaatggacatacccgctcttggaaggaagaagggcgacccatgcaatgtcgccgacaatttcgaagcgacaggagcttacgccaagggcctcatcacggcagaagagcgtgtcgacctgatccgcaacgcctgtcccggtcctggtgcttgcggaggcatgtacaccgccaacaccttgtctatcgcgatcgaagtcatggggatgggtctcccgttgaccagcagtactcccgctgtctaccctgaaaagatgcaagaatgtctgcgtgttggagcctacatcaagaatctgctagccaaggatatcaagcctcgcgacatcatgaccaagaaggcttttgagaatgctatcgtgatgactcatgttcttggtggctcgactaatgctgttctccatctcatcgctgttgcacgtgctggcgatatcgacattaccatcgacgacttccaaaggctcggcgacaagacacccatgttggccgacgtcaagccatcgggcaagtattacatggaagacattcacaagatcggaggtgttcctcgtgtgctcaagtacattctggagaacacggatctgcttcatggtgacgtgatgacggtgacgggtaaaacgatgcgcgagaatctcgtcgatgttgaaccactggagtttgagacgcaagatatcatccgacctctcagcaaccctatcaaggcaacgggccacctgaccatcatgcgtggatcgctgtgccccggcggagctgtgtccaagctgacgggcaaagaggggctgtactttgacggcagcgctgttgtctttgactctgaagacggcatcaccgaagcaatcgcagaaggccgtgtcaaagaaggcagcgttgtcgtcattcgctatgttggaccaaaaggtggtcctggtatgcccgagatgctcggaccaaccggtgcgatcatgggcgcaggtctcggaaaaacagtagcgctcatcaccgacggtcgtttctctggcgcttcgcacggattttgcacaggacatgttgtgccagaagcagccctgggaggaccgatcgcgctcgtacaagacggagacaggatcactgtcgatgccaacacgcgcgagatcaacttgcacatcagtgacgaagagatggagaagaggaaacagtggtggctcaaagagaaaaagcctactctgacaaagaaacacaagcgcggttggctgtacaagtttgcaagggatgtacaaaacgcttccgagggttgtgttactgatcgcgatctgttttga

SEQ ID NO: 670 - protein, 597 aa, Ustilago maydis
MVNGEVELRTTSRTNGDAPAPILNRISRYITQSSDKGAAQSMLHACGLSVQDLDKPQVGISSVWWEGNPCNTHLLEFGRKIKQGCEAEGLVGLQNNTVGVSDAITMGGPGMQYSLPSRELIADSIETITLAQYHDANVSIPGCDKNMPGCLIACLRHNRPSIIVYGGTIQPGKHGMDIPALGRKKGDPCNVADNFEATGAYAKGLITAEERVDLIRNACPGPGACGGMYTANTLSIAIEVMGMGLPLTSSTPAVYPEKMQECLRVGAYIKNLLAKDIKPRDIMTKKAFENAIVMTHVLGGSTNAVLHLIAVARAGDIDITIDDFQRLGDKTPMLADVKPSGKYYMEDIHKIGGVPRVLKYILENTDLLHGDVMTVTGKTMRENLVDVEPLEFETQDIIRPLSNPIKATGHLTIMRGSLCPGGAVSKLTGKEGLYFDGSAVVFDSEDGITEAIAEGRVKEGSVVVIRYVGPKGGPGMPEMLGPTGAIMGAGLGKTVALITDGRFSGASHGFCTGHVVPEAALGGPIALVQDGDRITVDANTREINLHISDEEMEKRKQWWLKEKKPTLTKKHKRGWLYKFARDVQNASEGCVTDRDLF

SEQ ID NO: 671 - DNA, 1851 bp, Escherichia coli
atgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctgcgcgatctcggtaaactggtcgccgaacaaattgaagcggctggcggcgttgccaaagagttcaacaccattgcggtggatgatgggattgccatgggccacggggggatgctttattcactgccatctcgcgaactgatcgctgattccgttgagtatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactttccgatcagatcatcaagctcgatctggttgatgcgatgatccagggcgcagacccgaaagtatctgactcccagagcgatcaggttgaacgttccgcgtgtccgacctgcggttcctgctccgggatgtttaccgctaactcaatgaactgcctgaccgaagcgctgggcctgtcgcagccgggcaacggctcgctgctggcaacccacgccgaccgtaagcagctgttccttaatgctggtaaacgcattgttgaattgaccaaacgttattacgagcaaaacgacgaaagtgcactgccgcgtaatatcgccagtaaggcggcgtttgaaaacgccatgacgctggatatcgcgatgggtggatcgactaacaccgtacttcacctgctggcggcggcgcaggaagcggaaatcgacttcaccatgagtgatatcgataagctttcccgcaaggttccacagctgtgtaaagttgcgccgagcacccagaaataccatatggaagatgttcaccgtgctggtggtgttatcggtattctcggcgaactggatcgcgcggggttactgaaccgtgatgtgaaaaacgtacttggcctgacgttgccgcaaacgctggaacaatacgacgttatgctgacccaggatgacgcggtaaaaaatatgttccgcgcaggtcctgcaggcattcgtaccacacaggcattctcgcaagattgccgttgggatacgctggacgacgatcgcgccaatggctgtatccgctcgctggaacacgcctacagcaaagacggcggcctggcggtgctctacggtaactttgcggaaaacggctgcatcgtgaaaacggcaggcgtcgatgacagcatcctcaaattcaccggcccggcgaaagtgtacgaaagccaggacgatgcggtagaagcgattctcggcggtaaagttgtcgccggagatgtggtagtaattcgctatgaaggcccgaaaggcggtccggggatgcaggaaatgctctacccaaccagcttcctgaaatcaatgggtctcggcaaagcctgtgcgctgatcaccgacggtcgtttctctggtggcacctctggtctttccatcggccacgtctcaccggaagcggcaagcggcggcagcattggcctgattgaagatggtgacctgatcgctatcgacatcccgaaccgtggcattcagttacaggtaagcgatgccgaactggcggcgcgtcgtgaagcgcaggacgctcgaggtgacaaagcctggacgccgaaaaatcgtgaacgtcaggtctcctttgccctgcgtgcttatgccagcctggcaaccagcgccgacaaaggcgcggtgcgcgataaatcgaaactggggggttaa

SEQ ID NO: 672 - protein, 616 aa, Escherichia coli
MPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQIIKLDLVDAMIQGADPKVSDSQSDQVERSACPTCGSCSGMFTANSMNCLTEALGLSQPGNGSLLATHADRKQLFLNAGKRIVELTKRYYEQNDESALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPQTLEQYDVMLTQDDAVKNMFRAGPAGIRTTQAFSQDCRWDTLDDDRANGCIRSLEHAYSKDGGLAVLYGNFAENGCIVKTAGVDDSILKFTGPAKVYESQDDAVEAILGGKVVAGDVVVIRYEGPKGGPGMQEMLYPTSFLKSMGLGKACALITDGRFSGGTSGLSIGHVSPEAASGGSIGLIEDGDLIAIDIPNRGIQLQVSDAELAARREAQDARGDKAWTPKNRERQVSFALRAYASLATSADKGAVRDKSKLGG

SEQ ID NO: 673 - DNA, 1677 bp, Bacillus subtilis
atggcagaattacgcagtaatatgatcacacaaggaatcgatagagctccgcaccgcagtttgcttcgtgcagcaggggtaaaagaagaggatttcggcaagccgtttattgcggtgtgtaattcatacattgatatcgttcccggtcatgttcacttgcaggagtttgggaaaatcgtaaaagaagcaatcagagaagcagggggcgttccgtttgaatttaataccattggggtagatgatggcatcgcaatggggcatatcggtatgagatattcgctgccaagccgtgaaattatcgcagactctgtggaaacggttgtatccgcacactggtttgacggaatggtctgtattccgaactgcgacaaaatcacaccgggaatgcttatggcggcaatgcgcatcaacattccgacgatttttgtcagcggcggaccgatggcggcaggaagaacaagttacgggcgaaaaatctccctttcctcagtattcgaaggggtaggcgcctaccaagcagggaaaatcaacgaaaacgagcttcaagaactagagcagttcggatgcccaacgtgcgggtcttgctcaggcatgtttacggcgaactcaatgaactgtctgtcagaagcacttggtcttgctttgccgggtaatggaaccattctggcaacatctccggaacgcaaagagtttgtgagaaaatcggctgcgcaattaatggaaacgattcgcaaagatatcaaaccgcgtgatattgttacagtaaaagcgattgataacgcgtttgcactcgatatggcgctcggaggttctacaaataccgttcttcatacccttgcccttgcaaacgaagccggcgttgaatactctttagaacgcattaacgaagtcgctgagcgcgtgccgcacttggctaagctggcgcctgcatcggatgtgtttattgaagatcttcacgaagcgggcggcgtttcagcggctctgaatgagctttcgaagaaagaaggagcgcttcatttagatgcgctgactgttacaggaaaaactcttggagaaaccattgccggacatgaagtaaaggattatgacgtcattcacccgctggatcaaccattcactgaaaagggaggccttgctgttttattcggtaatctagctccggacggcgctatcattaaaacaggcggcgtacagaatgggattacaagacacgaagggccggctgtcgtattcgattctcaggacgaggcgcttgacggcattatcaaccgaaaagtaaaagaaggcgacgttgtcatcatcagatacgaagggccaaaaggcggacctggcatgccggaaatgctggcgccaacatcccaaatcgttggaatgggactcgggccaaaagtggcattgattacggacggacgtttttccggagcctcccgtggcctctcaatcggccacgtatcacctgaggccgctgagggcgggccgcttgcctttgttgaaaacggagaccatattatcgttgatattgaaaaacgcatcttggatgtacaagtgccagaagaagagtgggaaaaacgaaaagcgaactggaaaggttttgaaccgaaagtgaaaaccggctacctggcacgttattctaaacttgtgacaagtgccaacaccggcggtattatgaaaatctag

SEQ ID NO: 674 - protein, 558 aa, Bacillus subtilis
MAELRSNMITQGIDRAPHRSLLRAAGVKEEDFGKPFIAVCNSYIDIVPGHVHLQEFGKIVKEAIREAGGVPFEFNTIGVDDGIAMGHIGMRYSLPSREIIADSVETVVSAHWFDGMVCIPNCDKITPGMLMAAMRINIPTIFVSGGPMAAGRTSYGRKISLSSVFEGVGAYQAGKINENELQELEQFGCPTCGSCSGMFTANSMNCLSEALGLALPGNGTILATSPERKEFVRKSAAQLMETIRKDIKPRDIVTVKAIDNAFALDMALGGSTNTVLHTLALANEAGVEYSLERINEVAERVPHLAKLAPASDVFIEDLHEAGGVSAALNELSKKEGALHLDALTVTGKTLGETIAGHEVKDYDVIHPLDQPFTEKGGLAVLFGNLAPDGAIIKTGGVQNGITRHEGPAVVFDSQDEALDGIINRKVKEGDVVIIRYEGPKGGPGMPEMLAPTSQIVGMGLGPKVALITDGRFSGASRGLSIGHVSPEAAEGGPLAFVENGDHIIVDIEKRILDVQVPEEEWEKRKANWKGFEPKVKTGYLARYSKLVTSANTGGIMKI

SEQ ID NO: 675 - DNA, 1836 bp, Agrobacterium tumefaciens
atgccagcctatcgctccagaacgacaacccacggccgcaacatggcgggcgcgcgcggcctttggcgcgccaccggcatgaaggacagcgatttcggcaagccgatcatcgcggtggtcaattccttcacgcagttcgtaccgggccatgtgcatctaaaggatctcggccagctcgttgcccgcgaaatcgaggcggccggcggcgttgccaaggaattcaacacgattgcggtcgatgatggtatcgccatgggccatgacggcatgctctattcgctgccgtcgcgcgagatcatcgctgactcggtcgaatatatggtcaatgcccattgcgccgatgcgatggtctgcatttccaactgcgacaagatcacgcccggcatgctgaatgccgcgatgcgcctcaacattcccgccgttttcgtgtccggtggtccaatggaagcgggcaaggtggttctgcacggcaagaccgttgcgctcgatctggtcgacgcgatggtggctgctgccgacgacaagatttccgatgaggacgtcaagatcatcgagcgctccgcctgcccgacctgcggttcctgttccggcatgttcacggccaattccatgaactgtctgaccgaggcgctcggcctgtcattgcccggcaacggctcgacgcttgccacccactccgatcgcaagcgcctgttcgttgaagccggtcacctgatcgtcgatctggcccgccgttattacgagcaggacgacgaaaccgttctgccgcgcaccatcgccaacaaggcggcgttcgaaaacgccatgtcgctggatattgccatgggcggctccaccaacacggttctgcatattctggcggcagcccacgagggcggcgtcgatttcggtatggaggacatcgaccggctttcccgcaaggttccctgcctttccaaggttgcgcctgcgaagcaggatgtgcacatggaagacgtgcatcgcgccggcggcatcatgcgtattctcggtgagctggagcgtggcggtctcatcaaccgcgatacctataccgtacacgaagcgacgcttggcgatgccatcgaccgctgggacatcacgcgcaccaacagcgaaatggtgcggcagttcttcaaggccgctccgggcggcgtaccgacacaggtggccttcagccagtcctcgcgctgggatgatctggacaccgacagcgacaacggcgtcattcgttcggtcgagaagcctttctccaaggatggcggtctggccgttctttacggcaacatcgcgctcgatggctgcatcgtgaagacggcgggtgttgatgaatccatcctgaaattcaacggatcggcagtcgtttacgaaagccaggacgcggccgtgaagggcattctcggcaacgaggtcaaggcgggcgacgtcgtcgtcatccgctatgaaggaccgaagggcggcccgggcatgcaggaaatgctctatccgaccagctacctcaagtccaagggcctcggtaaagcctgcgcgctcatcaccgatggtcgcttctccggtggcacgtcaggcctttccatcggtcatgcctcgccggaagcggcgcagggcggtgccatcggcctcgtgcgtcagggcgacctgattgagatcgatattccgaaccgcacgatcaatctcaaggtttcggatgcggaactggccgcgcgccgggccgagcaggaagaaaagggctggaagccggaagcaccgcgcaagcgtaatgtcacgacggcgctcaaggcctatgcggcctttgcgtcgagcgcggacaagggtgctgtgcggattctgccggagtaa

SEQ ID NO: 676 - protein, 611 aa, Agrobacterium tumefaciens
MPAYRSRTTTHGRNMAGARGLWRATGMKDSDFGKPIIAVVNSFTQFVPGHVHLKDLGQLVAREIEAAGGVAKEFNTIAVDDGIAMGHDGMLYSLPSREIIADSVEYMVNAHCADAMVCISNCDKITPGMLNAAMRLNIPAVFVSGGPMEAGKVVLHGKTVALDLVDAMVAAADDKISDEDVKIIERSACPTCGSCSGMFTANSMNCLTEALGLSLPGNGSTLATHSDRKRLFVEAGHLIVDLARRYYEQDDETVLPRTIANKAAFENAMSLDIAMGGSTNTVLHILAAAHEGGVDFGMEDIDRLSRKVPCLSKVAPAKQDVHMEDVHRAGGIMRILGELERGGLINRDTYTVHEATLGDAIDRWDITRTNSEMVRQFFKAAPGGVPTQVAFSQSSRWDDLDTDSDNGVIRSVEKPFSKDGGLAVLYGNIALDGCIVKTAGVDESILKFNGSAVVYESQDAAVKGILGNEVKAGDVVVIRYEGPKGGPGMQEMLYPTSYLKSKGLGKACALITDGRFSGGTSGLSIGHASPEAAQGGAIGLVRQGDLIEIDIPNRTINLKVSDAELAARRAEQEEKGWKPEAPRKRNVTTALKAYAAFASSADKGAVRILPE

SEQ ID NO: 677 - DNA, 1902 bp, Burkholderia cenocepacia
gtgcctccacccttttcccgcgatatttcttcagccatcaccatgcccacttaccgttccaaaacctccaccgccggccgcaacatggcaggtgcgcgctcgctgtggcgcgccaccggcatgaaagacgacgatttctcgaaaccgatcatcgcggtcgtcaactcgttcacgcaattcgtgcccgggcacgtgcacctgaaggatctcggccagctcgtcgcgcgcgagatcgaggctgccggcggcgtcgcgaaggaattcaacacgatcgcggtcgacgacggcatcgcgatgggccacgacggcatgctgtactcgctgccgagccgcgacatcatcgccgactcggtcgaatacatggtgaacgcgcactgcgcggacgcgatggtgtgcatctcgaactgcgacaagatcacgccggggatgctgatggccgcgatgcgcctgaacattccggtgatcttcgtgtcgggcggcccgatggaagccggcaagacgcgcctcgcgaacccggtcaccaagaccgtcgaactgaagaagctcgacctcgtcgacgcgatggtgatcgcggccgaccagtcgtattcggacgccgacgtcgccgaagtcgaacgctcggcctgcccgacctgcggctcgtgctcgggcatgttcaccgcgaactcgatgaactgcctgaccgaagcgctcggcctgtcgctgcccggcaacggtacggtggtcgccacgcacgccgatcgcgaacagctgttcaagcgcgccggccgccgcatcgtcgaactgacgcgccagcactacgagcaggacgacgaacgcgtgctgccgcgctcggtcggcttcaaggcgttcgagaacgcgatgacgctcgacatcgcgatgggcggctcgaccaacacgatcctgcacctgctcgcgatcgcgcaggaagccggcatcgacttcacgatgaaggacatcgaccgcctgtcgcgcaccgtgccgcagctgtgcaaggtcgcgccgaacacgaacaagtaccacatcgaggacgtgcaccgcgccggcggcatcatggcgatcctcggcgagctcgagcgcgccggcaagctgcacaccgacgtgccgaccgtccatgcgccgacgctgaaggatgcgctcgaccagtgggacatcgtcctcacgcaggacgaagcggtccgcaggttctacctggccggcccggccggcatcccgacgcaggtcgcgttcagccagaacacgcgctggccgagcctcgacctcgaccgcgccgaaggctgcatccgctcgtacgagcatgcgttctcgaaggaaggcggcctcgcggtgctgacgggcaacatcgcgctcgacggctgcgtggtgaagacggccggcgtcgacgaaagcatcctcgttttcgaaggctcggcgcacgtgaccgaatcgcaggacgaagcggtcgagaacatcctcaacgacaaggtcaaggccggcgacgtggtgatcgtgcgctacgaaggcccgaagggcggcccgggcatgcaggaaatgctctacccgaccagctacatcaagtcgaaagggctcggcaaggcgtgtgcgctgctgacggacggccggttctcgggtggtacgtcggggctgtcgatcggccattgctcgccggaagcggcggcaggcggcgcgatcggcctcgtgcgcgacggcgaccggatccgcatcgacattccgaaccgcacgatcgacgtgctggtgtcggacgaggaactggcgcgccgccgcgaggagcagaacgcgaagggctggaagcctgcgcagccgcgtccgcgcaaggtgtccgcggcgctcaaggcgtacgcgaagctcgtcatgtcggccgacaagggcgccgtgcgcgatctgtcgctgctcgacgactga

SEQ ID NO: 678 - protein, 633 aa, Burkholderia cenocepacia
MPPPFSRDISSAITMPTYRSKTSTAGRNMAGARSLWRATGMKDDDFSKPIIAVVNSFTQFVPGHVHLKDLGQLVAREIEAAGGVAKEFNTIAVDDGIAMGHDGMLYSLPSRDIIADSVEYMVNAHCADAMVCISNCDKITPGMLMAAMRLNIPVIFVSGGPMEAGKTRLANPVTKTVELKKLDLVDAMVIAADQSYSDADVAEVERSACPTCGSCSGMFTANSMNCLTEALGLSLPGNGTVVATHADREQLFKRAGRRIVELTRQHYEQDDERVLPRSVGFKAFENAMTLDIAMGGSTNTILHLLAIAQEAGIDFTMKDIDRLSRTVPQLCKVAPNTNKYHIEDVHRAGGIMAILGELERAGKLHTDVPTVHAPTLKDALDQWDIVLTQDEAVRRFYLAGPAGIPTQVAFSQNTRWPSLDLDRAEGCIRSYEHAFSKEGGLAVLTGNIALDGCVVKTAGVDESILVFEGSAHVTESQDEAVENILNDKVKAGDVVIVRYEGPKGGPGMQEMLYPTSYIKSKGLGKACALLTDGRFSGGTSGLSIGHCSPEAAAGGAIGLVRDGDRIRIDIPNRTIDVLVSDEELARRREEQNAKGWKPAQPRPRKVSAALKAYAKLVMSADKGAVRDLSLLDD

SEQ ID NO: 679 - DNA, 1911 bp, Psychrobacter cryohalolentis
atggattacaattcaaaaacctctaccggcggtcgtaatatggcaggtgctcgtgccctgtggcgcgcaactggcatgactgatggcgactttggcaaacctattattgcaattgccaactcttttacccagtttgtacccggccatgtgcatttaaaagatttgggacaaatggttgcacgcgagattgaaaaagcgggtggcgtggcaaaagaatttaataccattgctgttgatgatggtattgccatgggtcatagcggcatgttgtattcactaccgagtcgagatttgattgctgattctgtcgagtatatggtcaatgcccactgcgccgatgcgctagtatgtatttctaactgcgataaaatcactccgggtatgttgatggcagccatgcgcctcaatatccccgtcgtctttatttcaggtggcccaatggaagcgggtaaaattatcgccagcacggtcgcacacagtcataataatgatggtagtagcgacgtccatagcactgacagtaaaggtaatgccattcgtaagcttgacctcgttgatgcgatgatggacgcggccgatgatagcattagtgatgaagatgtcgctgctattgaggcctcagcgtgcccgacttgtgggtcgtgctctggcatgttcactgccaactcgatgaattgcttgaccgaagcattaggattggcattaccgggtaatggctcgctattggcaacccattcgctacgtcgcgagctattcctagaagcgggtcgtactatcgtgtcactagccaaacgtcgctacgagcaagatgatgattcagtcctaccgcgctctatcgctactaaagccgcgtttgaaaatgccatgactttagacatcgccatgggcggctctaccaatactattttgcatttgcttgctgctgcacatgaagccgaagtcgacttcaaaatgcacgatattgaccgtttaagtcgtggcgtcccttgtttggctaaagttgcccctgcttcacaaaagtatcatatggaagatgtgcatcgtgctggtggtgtctttgcgctattggccgagcttgaccgtgctggtttgctgcataccgatttgccaactatccatagtgccacgatgaaagaagcgattgataaatgggatattatgaatcctgacaatcttgaagcacgtgcacgctatattgcagcccctggtggcgtacggacgactgaggctttctcacaatcaaaagaatggtcaaatctggatgtgaaccgagagtcaggctgtatccgaagtgcccaacatgcttattcaactgatggcggtcttgccgttctatacggaaacattgctgagcgtggctgtgtggtcaaaactgccggcgttgatgacagcatcttggttttcaccggacgtgcacgcatctttgaatcacaagatgatgcagtagcagcggtgcttgatgatcaaatcgtcgcaggcgatgtagttatcatccgttttgagggtccaaaaggcggtcctggtatgcaagagatgctctacccgacgacttatctaaaatctaaaggcctaggcaaagaatgtgcgctgcttacagatggtcgcttctctggtgggacatcaggcttgtctattggtcatgccagcccagaagccgctgaaggcggcgccattggcctagtgcaagaaggcgatactatccatattgatatcccaaaccgtaccatcaatatgcaggtcagtgatgaagagttagctgctcgccgcgaagaaatggaaagtcgtggacgtgatgcttggaaacccgttagccgtgagcgtcatgtctctcctgctttacgtgcctatgctgcaatgaccaccagtgccgatacgggcgctgtacgtgacgtcagccaagttgaacgttag

SEQ ID NO: 680 - protein, 636 aa, Psychrobacter cryohalolentis
MDYNSKTSTGGRNMAGARALWRATGMTDGDFGKPIIAIANSFTQFVPGHVHLKDLGQMVAREIEKAGGVAKEFNTIAVDDGIAMGHSGMLYSLPSRDLIADSVEYMVNAHCADALVCISNCDKITPGMLMAAMRLNIPVVFISGGPMEAGKIIASTVAHSHNNDGSSDVHSTDSKGNAIRKLDLVDAMMDAADDSISDEDVAAIEASACPTCGSCSGMFTANSMNCLTEALGLALPGNGSLLATHSLRRELFLEAGRTIVSLAKRRYEQDDDSVLPRSIATKAAFENAMTLDIAMGGSTNTILHLLAAAHEAEVDFKMHDIDRLSRGVPCLAKVAPASQKYHMEDVHRAGGVFALLAELDRAGLLHTDLPTIHSATMKEAIDKWDIMNPDNLEARARYIAAPGGVRTTEAFSQSKEWSNLDVNRESGCIRSAQHAYSTDGGLAVLYGNIAERGCVVKTAGVDDSILVFTGRARIFESQDDAVAAVLDDQIVAGDVVIIRFEGPKGGPGMQEMLYPTTYLKSKGLGKECALLTDGRFSGGTSGLSIGHASPEAAEGGAIGLVQEGDTIHIDIPNRTINMQVSDEELAARREEMESRGRDAWKPVSRERHVSPALRAYAAMTTSADTGAVRDVSQVER

SEQ ID NO: 681 - DNA, 1851 bp, Psychromonas sp.
atgcccaaattacgttcagcaactagtacagaaggccgaaacatggcaggcgcgcgtgcattgtggcgcgccactggcgtcaaagataatgattttggaaaacctattattgccattgcgaattcatttacccaatttgttcctgggcatgtacatcttaaaaacatgggtgatttagtggcgggtgcgattgctgaggcgggcggtatctctaaagaatttaataccattgcggttgatgacggcattgcgatgggccattcaggtatgctttatagtttaccttcacgtgacctgattgctgatagtgttgaatatatggtaaatgcacattgtgcggatgctttagtgtgtatttcaaattgtgacaagatcacgccggggatgttgatggcggcattacgccttaatattccggttgtttttgtctcaggtggcccgatggaagcgggtaaaaccaagctttcagataaaattattaagttagatttggtcgatgccatggtggcgggcgcagacgacaggatctccgacgctgacagtgcacaaattgagcgcagtgcttgcccaacgtgtggctcttgctctggtatgtttaccgctaactccatgaactgtctaacggaagtcttagggttatcactacccggtaatggcactatgcttgcaacgcacgcagacagacgcgctcttttcttagaagcgggaaagtgcattgtggcattaacgaaacgttattatgacgatgacgatgagtctgttttaccgcgtaatattgccaattttaaagcctttgaaaacgccatgacacttgatattgcgatgggaggctcaagtaatacggtgctgcatttattagctgctgcccaagaagcgcatattgattttaacatggatgatattgatagaatttcacgcttagtgcctcatttgtgcaaagttgccccctctacacctaaatatcatatggaagatgtgcaccgcgcaggtggggtaatgggtattttaggcgaattggacagagccggccttattcataatgacgctaatcatgtggcgggcagtagtttaaaagcggtattagagaaatgggatattgtgcaaactaaagaggcgagtgtgcgtgatttttaccgcgcaggtccgggaggtattccaactcagcaagcttttagtcaggatagtcgctgggatagtgtggatgatgacaggcagaatggctgtattcgtaaacgtgaatttgcgtttagccaagaaggcggacttgccgtgctggcgggtaatattgcgccaaagggctgtattgttaaaacggcgggggtcgatgaagaagagcatcaatttaccggtacggcgcgcgtgtttgagagccaagatgatgcagtgagcgccatcttagcgggaaaagtgattgcgggtgatgtggttgtcattcgttatgaaggccccaaaggtggccccggcatgcaagaaatgttgtatcccaccagttatttaaaatcacgtgggttaggtaaatcatgtgccttaataaccgacggacgattttcgggtggaacctcgggcttatcgattgggcatatttctccagaggctgcagcgggcggtaatattgccttgattgagacgggtgatgttatcaaaattgatattcctgcacgcagtattcaccttgatattagtgatgaagagctcaagttacgccataaaaatatgctagcgcgcggtaaacttgcttggaaacccgtttcgagaaaacgtattgtgccactcgcgcttaaagcttacgctttgctggtgaccagtgcagataaaggggcggttcgtgacgcttcaatgttggaggattaa

SEQ ID NO: 682 - protein, 616 aa, Psychromonas sp.
MPKLRSATSTEGRNMAGARALWRATGVKDNDFGKPIIAIANSFTQFVPGHVHLKNMGDLVAGAIAEAGGISKEFNTIAVDDGIAMGHSGMLYSLPSRDLIADSVEYMVNAHCADALVCISNCDKITPGMLMAALRLNIPVVFVSGGPMEAGKTKLSDKIIKLDLVDAMVAGADDRISDADSAQIERSACPTCGSCSGMFTANSMNCLTEVLGLSLPGNGTMLATHADRRALFLEAGKCIVALTKRYYDDDDESVLPRNIANFKAFENAMTLDIAMGGSSNTVLHLLAAAQEAHIDFNMDDIDRISRLVPHLCKVAPSTPKYHMEDVHRAGGVMGILGELDRAGLIHNDANHVAGSSLKAVLEKWDIVQTKEASVRDFYRAGPGGIPTQQAFSQDSRWDSVDDDRQNGCIRKREFAFSQEGGLAVLAGNIAPKGCIVKTAGVDEEEHQFTGTARVFESQDDAVSAILAGKVIAGDVVVIRYEGPKGGPGMQEMLYPTSYLKSRGLGKSCALITDGRFSGGTSGLSIGHISPEAAAGGNIALIETGDVIKIDIPARSIHLDISDEELKLRHKNMLARGKLAWKPVSRKRIVPLALKAYALLVTSADKGAVRDASMLED

SEQ ID NO: 683 - DNA, 1824 bp, Deinococcus radiodurans
atgccgacttaccgttccagaaccaccaccgagggccgtaatatggccggcgcccgtgccctgtggcgcgccaccggcatgaccgacggcgatttccagaagccgatcatcgcggtggtcaactcgttcacccagttcgtgccggggcacgtgcacctcaaggacctcgggcaactcgtcgcgggtgaaatcgcggcggcgggcggcgtggcgaaggagttcaacaccatcgccgtggacgacggcatcgccatgggccacgacgggatgctctactcactgcccagccgcgaaatcatcgccgacagcgtggagtacatggtcaacgcccactgcgccgacgcgatggtttgcatctccaactgcgacaagattacccccggcatgctgatggccgcgctgcgcctcaatatccccaccgtgttcgtctcgggcgggccgatggaagcgggcaaggtcaagctcggtgacggcgagcacgcgctggacctggtggacgcaatggtgatggccgccgacgacagcgtgagcgaggaagacatcgaactggtggagcgctcggcctgccccacctgcggctcgtgctcgggcatgttcaccgccaactcgatgaactgcctgacggaggcgctgggcctctcgctgccgggcaacggctcggtgctggcgacccactccgaccgccagaacctgttcaagcgcgccgggcacctgatcgtggacctcgccaagcgctactacgagggcgatgacgagagcgtgctgccgcgcagtgtcgccacctacgacgccttcgagaacgccatgaccctcgacatctcgatgggcggctcgaccaatacggtgctgcacctgctggccgccgcgcacgaggccggggtggatttcaccatgcaggacatcgaccagctctcgcggcgggtgccggtgctgtgcaaggtggcgcccgccaagaacgacgtgcacatggaagacgtgcaccgcgctgggggcatcatgggcattctgggcgagcttgaccgcgccgggctgctgaagaccgacgtgagcaccgtacacgcccccagcatgagcgccgccctgaacgagtgggacgtggtccgcaatgagaaccaccacgagttctaccgcgccgcgcccggcggcattcccaccgtcttcgccttctcgcagtcgcgccgttaccgcgaactcgacaccgaccgggaagcaggcgtcattcgcagcgccgagcacgctttctcgcaggacggcgggctggcggtgctgtacggcaacctcgccgaagacggctgcatcgtcaagacggcgggcgtggacgaatccatcctgaagttcagcggcccggcgcgcgttttcgagtcgcaagacgcctcggtggacgccatcctcagcggcgaagtcaaggaaggcgaggtcgtgctgattcgctacgaaggcccacgcggtggccccggcatgcaggaaatgctctacccgacgagctacctcaagtccaaggggctgggcaaagcctgcgcgctggtcaccgacggtcgtttctcgggcggcagcagcggcctgagcatcggccacgtctcgcccgaggcggcggagggcggcaccatcggcctggtcgagacgggcgacctcatcgaaatcgacatcccgaaccgcaccattcacctcgccgtgccggacgctgaactcgccgcccgccgccagaagcgcgaggaagaaggctggcaccccgccgaaccccggccccgcaaaatcaccgctgccctacgcgcctatgcgtctatgacgacgagcgcttcgcggggcgcggtgcggaatatctga

SEQ ID NO: 684 - protein, 607 aa, Deinococcus radiodurans
MPTYRSRTTTEGRNMAGARALWRATGMTDGDFQKPIIAVVNSFTQFVPGHVHLKDLGQLVAGEIAAAGGVAKEFNTIAVDDGIAMGHDGMLYSLPSREIIADSVEYMVNAHCADAMVCISNCDKITPGMLMAALRLNIPTVFVSGGPMEAGKVKLGDGEHALDLVDAMVMAADDSVSEEDIELVERSACPTCGSCSGMFTANSMNCLTEALGLSLPGNGSVLATHSDRQNLFKRAGHLIVDLAKRYYEGDDESVLPRSVATYDAFENAMTLDISMGGSTNTVLHLLAAAHEAGVDFTMQDIDQLSRRVPVLCKVAPAKNDVHMEDVHRAGGIMGILGELDRAGLLKTDVSTVHAPSMSAALNEWDVVRNENHHEFYRAAPGGIPTVFAFSQSRRYRELDTDREAGVIRSAEHAFSQDGGLAVLYGNLAEDGCIVKTAGVDESILKFSGPARVFESQDASVDAILSGEVKEGEVVLIRYEGPRGGPGMQEMLYPTSYLKSKGLGKACALVTDGRFSGGSSGLSIGHVSPEAAEGGTIGLVETGDLIEIDIPNRTIHLAVPDAELAARRQKREEEGWHPAEPRPRKITAALRAYASMTTSASRGAVRNI

SEQ ID NO: 685 - DNA, 1680 bp, Wolinella succinogenes
atgagaagtagcatcattaaagaggggtatcaaaaggcgccacaccgaagcttgctgagggcaacggggctcaaagacgaggattttggtaagccattcattggcgtggccaacagctatattgacatcattccgggtcactttttcttgcaagagtatggccgaatcattaaagaggagattagggccgcgggcggaatcccttttgagtttaacactatcggggtggatgatggaatcgccatggggcatgatggaatgctctatagtttgcccagtcgagagctgattgctgattgtattgagacggtgatgaatgcccataaactggacgccatgatctgtatccctaattgcgacaagattgtccctgggatgcttctgggggcactcagagtgaatgtgcccacggtgtttgtgagtggcggaccgatgaaggcaggtcgcctcaaggatggcaccaaagtggatttggcgagtgcttttgaggcggtgggtaaacgcgcgaggaatcagattagcgatgaagagctccgcgagattgagtgcgccgcctgtccggggggaggaagctgcagtggaatgttcacggcgaactccatgaacacactctgtgaagcgatgggagtggcgcttcccgggaatgggacgattccagccctcaccaaagagcgtgaggagctcatccgaaaagccgcaagaagaatcgtagaaatcgcactagatgagcgctacgccttccgcaatattctcaacaaagaggcgattcacaatgcttttgttgtggatatggcgatggggggaagcaccaataccgtacttcatatgatggccattgccaaagagagagaggcggattttgatttgcgcaaaatcaatgagatcgccaaagaggtgagtcatatcgccaaaatctcccctgcactctacactgtccacatggaagacatcaatagagccgggggcgtgaatgcggtcatgaatgagatcaatcgccgaggcggagtgctcaagacagaggcgctcaccgtgagtggcgagagcatgggtgagaggatcgcgggggcgaagattttagatacgcaaatcattcacacgcttgagaatccctatagcgcggtggggggattgaagattctttatggaaatcttgccgagcagggcgctgtgctcaagaccgctgccatggacgctaagatgagaaaattcactggaaaggcagtctgctttgattctcaagaggaggcgatcgcaggtattgtcgggggcaaggtcaaagagggggatgtggtggtgatccgctacgaaggacccaaggggggaccgggaatgcaggagatgctaagtcccacaagcctcatcatggggatgaatttaggagacaaagtcgcgctcattaccgatggccgtttcagcggcgccacgcgtggcgcttgcatcgggcatgtgagtcccgaagcggccgaagggggaatgatcggactgcttcaagagggcgatcttattcgaatcgatgtcgaagaaggggttttggaggtgttgcttgaggaggcggagatccaaaagcgacgcgcctcctttagtcctaaaactaaaaccgttgcctccaagtggctcaaacgctaccagcttctcgtgagcaatgccgcttcaggcgctattttgaaaacggagctataa

SEQ ID NO: 686 - protein, 559 aa, Wolinella succinogenes
MRSSIIKEGYQKAPHRSLLRATGLKDEDFGKPFIGVANSYIDIIPGHFFLQEYGRIIKEEIRAAGGIPFEFNTIGVDDGIAMGHDGMLYSLPSRELIADCIETVMNAHKLDAMICIPNCDKIVPGMLLGALRVNVPTVFVSGGPMKAGRLKDGTKVDLASAFEAVGKRARNQISDEELREIECAACPGGGSCSGMFTANSMNTLCEAMGVALPGNGTIPALTKEREELIRKAARRIVEIALDERYAFRNILNKEAIHNAFVVDMAMGGSTNTVLHMMAIAKEREADFDLRKINEIAKEVSHIAKISPALYTVHMEDINRAGGVNAVMNEINRRGGVLKTEALTVSGESMGERIAGAKILDTQIIHTLENPYSAVGGLKILYGNLAEQGAVLKTAAMDAKMRKFTGKAVCFDSQEEAIAGIVGGKVKEGDVVVIRYEGPKGGPGMQEMLSPTSLIMGMNLGDKVALITDGRFSGATRGACIGHVSPEAAEGGMIGLLQEGDLIRIDVEEGVLEVLLEEAEIQKRRASFSPKTKTVASKWLKRYQLLVSNAASGAILKTEL

SEQ ID NO: 687 - DNA, 1857 bp, Zymomonas mobilis
atgcctccctatcgttccagaaccacgactcatggtcgtaatatggcgggtgccagaagtttatggcgcgcaaccggcgtcaaaaatgaagattttggtaagccgattatcgctgttgccaacagctttacgcaatttgtccccggtcatgtccatttaaaggatatgggacagcttgttgctgaagaaattgaaaaagctggcggtatcgccaaagaattcaatacgattgcgattgatgatggtatcgcgatgggacatggcgggatgctttattccttgccgtctcgggaattgattgccgattccgtcgaatatatggtcaacgcccattgtgctgatgctttggtctgtatttccaactgcgacaagattacgcctggtatgttgatggcttcgatgcgcctgaatatcccgacagttttcgtctctggtggacctatggaagccggtaaagccgaggtcaaaggcgtcaagcgggcgcttgatctgatcgatgctatggtgattgctgccgatgaccattacagcgatggtgaagtcgaagttatcgagcagacggcttgcgctacctgcggttcctgttccggtatgtttacggccaattcgatgaattgcctgaccgaggccttggggctttctttcccaggtaatggttcgatgcttgcgacccatagcgatcgggaacagcttttccgcaaggctgggcataccattgttgatatggcgcgcagctattatgagcaggatgatgccgctgtattaccgcgttcaattgccacgcttgaggcttttgaaaatgcgatgagtcttgatatcgccatgggtggttccaccaatacggttttgcatctgttggcggtcgcgcaggaaggcaacgtgcctttcactatggcggatattgatcgtctttcccgtcatgtcccttgcttatgcaaggtcgcaccggccaaaaatgatgtccatatggaagatgttcatcgggcagggggcgttatggccattttaggccagcttgatcgtgccggattgatcaataccagcttgcgcaccattcattctccgactttaggcgcagcattggacgcatgggatatcagccgtgacagttgttctgaagaagcgcagttattctatcgcgcggctccggggggtgttccgactcaaaaggctttcagccagtcttctcgctatgaagcgctggatactgaccgcgaaaaaggtgtgattcgttctaaaaatcatgctttttcgacggatggtggtctggccgtcttatttggcaatcttgctcctgaaggcagtattgtcaaaactgccggtgtggatgagtctattctgaaattcaccggtaaagccaaggtttacgaaagtcaggaagccgccgttgccggtattcttggcaatgatgtcgaagctggtgaagtggtgatcgttcgctatgaaggtcccaaaggtggccccggtatgcaggaaatgctgtatccgaccagctatctgaaatcgaaaggtttgggtaaactctgcgctctgattaccgatggtcgtttttctggtggtagctctggtttatccatcggccatgtttctcctgaagcggccgagggcggcttgatcgctttggtcgaaaccggtgatacaattgttatcgatattcctgaacggattatccatctggatgttgatgatgctgttattgccgatcgtcatgcccgcatggaagccaagggggcggcagcatggaaaccgcaaaaccgtaatcgtccgatttcttcggctttgaaagcctatgcagctttgacgacaaacgctgcccgtggggcagttcgagatgtcaatcagctcgaacggcgttaa

SEQ ID NO: 688 - protein, 618 aa, Zymomonas mobilis
MPPYRSRTTTHGRNMAGARSLWRATGVKNEDFGKPIIAVANSFTQFVPGHVHLKDMGQLVAEEIEKAGGIAKEFNTIAIDDGIAMGHGGMLYSLPSRELIADSVEYMVNAHCADALVCISNCDKITPGMLMASMRLNIPTVFVSGGPMEAGKAEVKGVKRALDLIDAMVIAADDHYSDGEVEVIEQTACATCGSCSGMFTANSMNCLTEALGLSFPGNGSMLATHSDREQLFRKAGHTIVDMARSYYEQDDAAVLPRSIATLEAFENAMSLDIAMGGSTNTVLHLLAVAQEGNVPFTMADIDRLSRHVPCLCKVAPAKNDVHMEDVHRAGGVMAILGQLDRAGLINTSLRTIHSPTLGAALDAWDISRDSCSEEAQLFYRAAPGGVPTQKAFSQSSRYEALDTDREKGVIRSKNHAFSTDGGLAVLFGNLAPEGSIVKTAGVDESILKFTGKAKVYESQEAAVAGILGNDVEAGEVVIVRYEGPKGGPGMQEMLYPTSYLKSKGLGKLCALITDGRFSGGSSGLSIGHVSPEAAEGGLIALVETGDTIVIDIPERIIHLDVDDAVIADRHARMEAKGAAAWKPQNRNRPISSALKAYAALTTNAARGAVRDVNQLERR

SEQ ID NO: 689 - DNA, 1659 bp, Clostridium acetobutylicum
gtgaattctgataaggcaatgaaaggagtagaaagagctccccacagatctctttttaaggctttaggttttatagatgaggaaatggatagacctcttataggaatagctaattcttacagcgaacttataccaggtcatatgaatcttgataaaatagttaaggctgtaaaagatggaataagaatggcaggaggtgttcctgtagaatttggaaccattggagtttgtgatggtatttctatgaatcataagggaatgagttattctcttccatcaagacagattatagcagatagtgttgagatcgtggctaaagcacatgctcttgatgggcttgtacttgtgccaaattgcgataaggtagttccaggaatgcttatggcggctggaagagttaacataccttcaatagtaataagtggaggaccaatgctttctggtagaacaaatggaagggtcacagatctaaactctgtattcgaagcagttggagcagtttcagcgggaaaaatgtctttagaagaattagctgagcttgagaatacggcatgccctacttgtgggtcttgttctggaatgtttacagcaaattcaatgaactgtctttctgaggttttaggtcttgcgcttccttacaatggaactataccagctgtattttcagaaagattaagacttgctaaaaaggcaggtatgaaaatagttgaattggttcaaaaggacataagaccaagtgacatacttacagaagctgcatttatgaatgcagtcgcaatggatatggcactagggggttctactaattcacttcttcatttaccagctatagcttatgaatgtgacgtggatattaatttcgataaaataaatgagataagtgaaaagattccgcatgtgtgtaagttaagtcctgcaggatttcatcacatagaggacttgcatatggcaggtggaataccggctgttgttaatggaattataaaaaaaggacttctaaatggagagtgtatgacagttacaggtaaaactttgtatgagaatgtgaaggatgcgaaaatcaaaaacattgatgtaataagaatagataatccttatagtgagacaggtggactttcagtattgagaggaaatttagctccagatggcgctatagttaaaaaggcagcagtagcacccgaaatgatgcagcatactggtccggctagggtatttaatagtgaagaggaagtttctaaggcaatacttggtggaaaaataaatccaggtgatgttgttgtgataaggtatgagggccctaagggtggaccaggaatgaaggaaatgctttcgccaacagcttcacttgcaggaatgggacttgataagagtgtggcgcttataactgatggaagattctcaggtgctacaagaggagcatccattggacatgtatctccagaagcggcagaaggtggtccaatagggttggttgaagagggagacacaattgaaatagatattgaaaagaaaactataaacctacttgttccggaagaaaaattaaaaaacagaaaaccggaaaaggttgaaaaacctgtgaagggatatttaaatacgtataggcagggggtatcatctgcttgtacaggagcagtttttcatagtacaaaggagtga

SEQ ID NO: 690 - protein, 552 aa, Clostridium acetobutylicum
MNSDKAMKGVERAPHRSLFKALGFIDEEMDRPLIGIANSYSELIPGHMNLDKIVKAVKDGIRMAGGVPVEFGTIGVCDGISMNHKGMSYSLPSRQIIADSVEIVAKAHALDGLVLVPNCDKVVPGMLMAAGRVNIPSIVISGGPMLSGRTNGRVTDLNSVFEAVGAVSAGKMSLEELAELENTACPTCGSCSGMFTANSMNCLSEVLGLALPYNGTIPAVFSERLRLAKKAGMKIVELVQKDIRPSDILTEAAFMNAVAMDMALGGSTNSLLHLPAIAYECDVDINFDKINEISEKIPHVCKLSPAGFHHIEDLHMAGGIPAVVNGIIKKGLLNGECMTVTGKTLYENVKDAKIKNIDVIRIDNPYSETGGLSVLRGNLAPDGAIVKKAAVAPEMMQHTGPARVFNSEEEVSKAILGGKINPGDVVVIRYEGPKGGPGMKEMLSPTASLAGMGLDKSVALITDGRFSGATRGASIGHVSPEAAEGGPIGLVEEGDTIEIDIEKKTINLLVPEEKLKNRKPEKVEKPVKGYLNTYRQGVSSACTGAVFHSTKE

SEQ ID NO: 691 - DNA, 1671 bp, Clostridium beijerinckii
atgagaagtgatgtaataacaaaaggatctaaaagtgcacctcaacgttcattgcttagtgccttaggtttaacaaaagaagaaatggaaaggcctcttgtaggtatcgtgagctcacaaaatgatatcgttcctggtcatatgaatttagacaaaatagttgaagctgtaaaaatgggagtttcaatggctggaggtactccaattgtctttcctgcaattgctgtttgtgacggtattgctatggggcatgaaggaatgaaatattcattagttacaagagatttaattgcagattctactgaagctatggcaatggctcatgcctttgatgcattagtaatggttcctaattgtgataaaaatgttcctggccttctaatggctgcagcaagagttaatattcctacaatttttgtaagtggcggaccaatgcttgccggaaaagttgacggatgtaagacaagcttatcaagtatgtttgaagctgttggcgcttacaatgctggaaaaattacagctgaaaaattagatgaatatgaaaacaacgtatgccctacttgtggttcttgttcaggaatgtatactgcaaatagtatgaactgtttaacggaagtacttggtatgggccttcaagggaatggtacaatccctgcagtttattcagaaagaataaaacttgcaaagcatgctggcatgaaaatcatggaattacttgaaaagaacataagaccaagagatattatgacagaagatgcatttatgaatgctatgactatggacatggctcttggctgtagtaccaatagtatgttgcatttacctgcaattgcacacgaagttggctttgatttaaatgttgatatagctaatgaaattagttcaaaaacaccgaatctttgccatcttgctcctgctggacacacttatattgaagatttaaatgatgctggtggaatttatgctgttatgaatgaaataaataagcttggtttattaaaaactaaccttataacatgtacaggaaaaactgttggtgaaaacattgaaggatgcataaataaaaatcctgaagttattagaccagtcaaaaatccatatagtcaaactggtgggattgcagttcttaaaggaaatctagcacctgattcatgtgtcgttaagcgttcagccgttgtaccaaaaatgttaaagcatgaaggtccagctaaagtgtttgattgcgaagaagatgcccttgaagcaataaatacaggaaaaattgttgctggagatgttgttgttatcagatatgaaggacctaaaggaggccctggcatgagagaaatgcttaatccaacttctgcaattgcaggaagaggtcttggaagttccgttgctcttataacagatggacgttttagtggcgctagcagaggtgcttcaatcgggcacgtttctccagaggcggcagtaggtggtaacatagcattagttgaggatggagatatgatccaaattgatattaacgctaacactattaacttcttagttagcgatgaagaattagcaagaagaaaagcaaattggaaaccaagaaaaccaaaaataactacaggttatctagcaagatacgctgctcttgttacatcaggaaatagaggtgctatcctagacatccctaaattttaa

SEQ ID NO: 692 - protein, 556 aa, Clostridium beijerinckii
MRSDVITKGSKSAPQRSLLSALGLTKEEMERPLVGIVSSQNDIVPGHMNLDKIVEAVKMGVSMAGGTPIVFPAIAVCDGIAMGHEGMKYSLVTRDLIADSTEAMAMAHAFDALVMVPNCDKNVPGLLMAAARVNIPTIFVSGGPMLAGKVDGCKTSLSSMFEAVGAYNAGKITAEKLDEYENNVCPTCGSCSGMYTANSMNCLTEVLGMGLQGNGTIPAVYSERIKLAKHAGMKIMELLEKNIRPRDIMTEDAFMNAMTMDMALGCSTNSMLHLPAIAHEVGFDLNVDIANEISSKTPNLCHLAPAGHTYIEDLNDAGGIYAVMNEINKLGLLKTNLITCTGKTVGENIEGCINKNPEVIRPVKNPYSQTGGIAVLKGNLAPDSCVVKRSAVVPKMLKHEGPAKVFDCEEDALEAINTGKIVAGDVVVIRYEGPKGGPGMREMLNPTSAIAGRGLGSSVALITDGRFSGASRGASIGHVSPEAAVGGNIALVEDGDMIQIDINANTINFLVSDEELARRKANWKPRKPKITTGYLARYAALVTSGNRGAILDIPKF

SEQ ID NO: 693 - DNA, 1842 bp, Pseudomonas fluorescens
atgcctgattaccgctcgaaaacatccacccatggccgcaacatggccggcgcccgcgccctgtggcgcgccacggggatgaaagatgacgacttcaagaagccgatcatcgccattgccaactccttcacccagttcgtcccggggcacgtgcacctgaaggacctgggccagctggtggctcgcgagatcgaacgcgccggtggcgtggccaaggaattcaacaccatcgccgtggacgacggcatcgccatgggccatgacggcatgctgtattcgctgccgagccgcgagatcatcgccgactccgtggagtacatggtcaacgcccactgtgccgacgccatcgtgtgcatttccaactgcgacaagatcacccccggcatgctgatggccgccctgcgcctgaacatcccggtgatcttcgtttccggcggcccgatggaagccggcaagaccaagctcgccagccatggcctggacctggtggacgccatggtcatcgccgccgactccagcgcttctgacgagaaggttgccgagtacgagcgcagcgcctgcccgacctgcggttcatgctccggcatgttcaccgccaactccatgaactgcctgaccgaagccctggggctcgccctgccgggcaacggttcgaccctggccacccacagcgatcgcgaagagctgttcctgcgggccgggcgcaccatcgtcgagctgtgccagcgctactacggcgacaacgacgagtcggtcctgccgcgcaacatcgccaacttcaaggcgttcgagaacgccatgaccctggatatcgccatgggcggttccaccaacaccatcctgcacctgctggccgccgcccaggaagccgagatcgacttcgacctgcgggacatcgatcgcctgtcgcgccacgtgccgcagctgtgcaaagtggcgccgaacatccagaagtaccacatggaagacgtgcaccgcgccggcggtatcttcagcatcctcggcgaactggcccgtggcggcctgctgcacaccgacctgcccaccgtgcacagcaagaccatggccgaaggcatcgcccagtgggacatcacccagaccagcgacgaagccgtgcatcacttcttcaaggccggcccggcgggcatcccgacccagacggcgttcagccagtcgacccgttgggacagcctcgacgatgaccgtgaaaacggctgcatccgcagtgtcgagcatgcctactcgaaagaaggcggcctggccgtgctctacggcaacatcgccctggacggctgcgtggtgaagaccgccggtgtcgacgagtcgatccatgtcttcgaaggcaacgccaagatcttcgagagccaggacagcgcggtgcgcggcatcctcgccgacgaggtgaaggaaggcgacatcgtgatcatccgttacgaaggcccgaaaggcggcccgggcatgcaggaaatgctctatccgacctcctacctgaagtccaagggcctgggcaaagcctgcgccctgctcaccgacggccgcttctccggcggcacctcgggcctgtccatcggccacgcctcgcctgaagcggcagccggtggcaccatcggcctggtgcaggacggcgacaaggtactgatcgacattcccaaccgctcgatcaacctgttggtcagcgacgaggaactggcggcccgccgtgtcgagcaggacaagaaaggctggaaaccggtggaagcacgcccgcgcaaggtgaccaccgcgctgaaggcctacgccctgctagccaccagcgccgacaagggtgcggtgcgcaacaaggccatgctcgacggcctgtga

SEQ ID NO: 694 - protein, 613 aa, Pseudomonas fluorescens
MPDYRSKTSTHGRNMAGARALWRATGMKDDDFKKPIIAIANSFTQFVPGHVHLKDLGQLVAREIERAGGVAKEFNTIAVDDGIAMGHDGMLYSLPSREIIADSVEYMVNAHCADAIVCISNCDKITPGMLMAALRLNIPVIFVSGGPMEAGKTKLASHGLDLVDAMVIAADSSASDEKVAEYERSACPTCGSCSGMFTANSMNCLTEALGLALPGNGSTLATHSDREELFLRAGRTIVELCQRYYGDNDESVLPRNIANFKAFENAMTLDIAMGGSTNTILHLLAAAQEAEIDFDLRDIDRLSRHVPQLCKVAPNIQKYHMEDVHRAGGIFSILGELARGGLLHTDLPTVHSKTMAEGIAQWDITQTSDEAVHHFFKAGPAGIPTQTAFSQSTRWDSLDDDRENGCIRSVEHAYSKEGGLAVLYGNIALDGCVVKTAGVDESIHVFEGNAKIFESQDSAVRGILADEVKEGDIVIIRYEGPKGGPGMQEMLYPTSYLKSKGLGKACALLTDGRFSGGTSGLSIGHASPEAAAGGTIGLVQDGDKVLIDIPNRSINLLVSDEELAARRVEQDKKGWKPVEARPRKVTTALKAYALLATSADKGAVRNKAMLDGL

SEQ ID NO: 695 - DNA, 1653 bp, Methanococcus maripaludis
atgataagtgataacgtcaaaaaaggagttataagatctccaaaccgagctcttttaaaagcttgcggatattcagacgaagacatggaaaaaccatttattggtgttgtaaacagcttcacagaagttgttcctggccacattcacttaaaaacattatcagaagcagttaaacatggtgtttatgcaaacggcggaacgccatttgaatttaatacaattggaatttgcgacggtattgcaatgggtcatgaaggtatgaaatactccttaccttcaagagaaatcattgcagatgctgttgaatcaatggcaagagcacacggttttgatggccttgttttaattcctacgtgtgataaaatcgttcctggaatgataatgggtgctttaagattaaatattccatttatcgtagttactgggggaccaatgcttccaggcgaattccaaggtaaaaaatgcgaacttattagtctttttgaaggggttggtgagtatcaggttggaaaaattactgaagaagaattaaaaagtattgaagaatgtgcgtgcccgggtgctggaagctgtgcagggctttacactgcaaacagtatggcatgccttacagaagctctcggactatctcttccaatgtgtgcaacaatacatgcggttgatgctcaaaaggttagaatcgctaaaaaaactggctctaaaattgttgacttggtaaaagaagatgtaaaaccaacagatatattgacaaaggaagcttttgaaaacgctattttagttgaccttgcacttggtggatcgacaaatacaacattacacattcctgcaattgcaaatgaaattgaaaataaattcataactctcgatgactttgatagattgagcaacgaagttccacacattgcatcaatcaaacccggtggagaacactacatgattgacctccataatgcaggaggtattcctgcagtattaaatgttttaaagggaaaaattagagatacaaaaacggttgacggaagaagtactttagaaattgcagaatctgtcaaatacataaattacgacgttataagaaaagtagaagctccagttcacgaaactgccggtttgagagttttaaaaggaaatcttgctccaaacggttgcgttgtaaaaatcggtgcagtaaatccaaaaatgtacaaacacgatggacctgcaaaagtttacaattcagaagatgaagcaatttctgcgatactcggtggaaaaattgtagaaggcgacgttatagtaattagatacgaaggaccatcaggtggcccgggaatgagagaaatgctctccccaacttcagcaatctgtggaatgggtcttgatgacagcgttgcattaattactgacggaagattcagtgggggaagcagaggtccatgtataggccacgtttctccagaagctgctgctggcggagtaattgctgcaattgaaaacggagatatcatcaaaattgacatgattggaaaagaaataaatgttgatttggatgaatcagtaattaaagaaagactttcaaaattggatgaatttgagcctaaaatcaaaaaaggctatttatcaagatattcaaggctcgtttcttcagctgatgaaggagcggttttaaaataa

SEQ ID NO: 696 - protein, 550 aa, Methanococcus maripaludis
MISDNVKKGVIRSPNRALLKACGYSDEDMEKPFIGVVNSFTEVVPGHIHLKTLSEAVKHGVYANGGTPFEFNTIGICDGIAMGHEGMKYSLPSREIIADAVESMARAHGFDGLVLIPTCDKIVPGMIMGALRLNIPFIVVTGGPMLPGEFQGKKCELISLFEGVGEYQVGKITEEELKSIEECACPGAGSCAGLYTANSMACLTEALGLSLPMCATIHAVDAQKVRIAKKTGSKIVDLVKEDVKPTDILTKEAFENAILVDLALGGSTNTTLHIPAIANEIENKFITLDDFDRLSNEVPHIASIKPGGEHYMIDLHNAGGIPAVLNVLKGKIRDTKTVDGRSTLEIAESVKYINYDVIRKVEAPVHETAGLRVLKGNLAPNGCVVKIGAVNPKMYKHDGPAKVYNSEDEAISAILGGKIVEGDVIVIRYEGPSGGPGMREMLSPTSAICGMGLDDSVALITDGRFSGGSRGPCIGHVSPEAAAGGVIAAIENGDIIKIDMIGKEINVDLDESVIKERLSKLDEFEPKIKKGYLSRYSRLVSSADEGAVLK

SEQ ID NO: 697 - DNA, 1653 bp, Methanococcus aeolicus
atgataagtgataacttaaagaagggagtttccagagctccaaacagaagtttattaaaggcatgcggatatacggacgaagaaatagaaaaaccattcataggtatagtaaatagctttacagaagtagttcccgggcatattcatttaaatacattggcagaagctgcaaaaaagggagtttatgcaaacggcggaacaccttttgaatttaacactatggccgtatgtgatggtatagctatgggacatgagggaatgagatattcattaccatcaagagagataatagctgatacagtagaaagtatggcgaaagctcatggatttgatggattggtgcttattccgtcctgtgataaaattgttcctggtatgattatgggggctctaagattaaatattccattcatagtaataactggcggacctatgcaacctggggagctccacggtaaaaagtatgaccttataagtgtgtttgaaggagttggagaatataatgttggaaaaattacaaaagaggaattaatggaaattgaaacctgtgcctgtccgggagctggtagctgtgctggattatttacggcaaatagtatggcctgtttaaccgaaacacttggtttatcccttcctatgtgtgctactacacatgcaacagatgccgaaaaggtgagaattgcaaaaagaagcggtatgaaaatagttgatttggtaaaagaagatataaaaccaacagatttattaacaaaggaatcatttgaaaatgcaatattggttgatttggctttgggaggttcttcaaatacaacacttcatattccagctttggcttatgaaatagcaccagagtttataactcttgacgattttgataggttatgcgacgaggtgccacatattgcttcattaaggccggggggagaccactttataagcgatttgcatagggcaggaggtattccagctgttttaaaaatattggagcaaaaaataagggatgctaacactgtaagcggtaaatctattaaagagataataaatgaggtaaaatacattgattataatataattagaccagtggataaaccagtgcatgagaccgcaggattaaggatattaaaaggaaatatagcacctgatggctgtgttgtaaaaattagtgctgtaaatccaaagatgtataaacacgaggggcctgcacgggtatttaattcagaggaggaaaccattgacgcaatacttgggggggacattaaagaaggagatgttgttgtaataagatatgaaggtccagcaggaggtccgggaatgagagaaatgttgtctccaacttctgctatttgtggtatgggattagatgactctgttgcacttattacagatggtagatttagtgggggaagtagaggtccatgtattggacatatctcaccagaggcaatggcaggaggtccaatagccataattgaagaaggagatataattgctattgatatgatggcaaaagaaataaacttaaaaataagcgaagaagagataaaagaaagattagctaattggaaaaaaccagaaataaaagttaaaaaaggatatatatcaagatatgctaaattagtatcttcggcaaatgaaggggcagtattgaaataa

SEQ ID NO: 698 - protein, 550 aa, Methanococcus aeolicus
MISDNLKKGVSRAPNRSLLKACGYTDEEIEKPFIGIVNSFTEVVPGHIHLNTLAEAAKKGVYANGGTPFEFNTMAVCDGIAMGHEGMRYSLPSREIIADTVESMAKAHGFDGLVLIPSCDKIVPGMIMGALRLNIPFIVITGGPMQPGELHGKKYDLISVFEGVGEYNVGKITKEELMEIETCACPGAGSCAGLFTANSMACLTETLGLSLPMCATTHATDAEKVRIAKRSGMKIVDLVKEDIKPTDLLTKESFENAILVDLALGGSSNTTLHIPALAYEIAPEFITLDDFDRLCDEVPHIASLRPGGDHFISDLHRAGGIPAVLKILEQKIRDANTVSGKSIKEIINEVKYIDYNIIRPVDKPVHETAGLRILKGNIAPDGCVVKISAVNPKMYKHEGPARVFNSEEETIDAILGGDIKEGDVVVIRYEGPAGGPGMREMLSPTSAICGMGLDDSVALITDGRFSGGSRGPCIGHISPEAMAGGPIAIIEEGDIIAIDMMAKEINLKISEEEIKERLANWKKPEIKVKKGYISRYAKLVSSANEGAVLK

SEQ ID NO: 699 - DNA, 1842 bp, Vibrio fisheri
atgccaacttatcgttcagccaccaccactcacggacgtaacatggccggagcacgcgctttatggcgtgcaactggcgttaaagaagatgactttggtaaacccatcattgctgttgttaactcatttactcaatttgttccgggtcacgtacatcttaaagacatgggacaacttgttgctggcgaaatagaaaaagccggcggtatcgccaaagagtttaatactatcgccgttgatgatggtatcgctatgggtcacggtggcatgctttattctctgccatcacgcgaactcattgcagactctgttgaatacatggttaatgctcactgtgctgatgctatggtatgtatttctaactgcgacaaaattaccccaggaatgatgatggctgcaatgcgtcttaacattccagtaatttttgtgtcaggcggcccaatggaagcaggaaaaactaagctttcagatcaaataatcaaactggatcttgttgatgcaatgatccaaggtgccgatcctacggtttccgatgctcaaagtgagcagatcgagcgttcagcttgtccaacttgtggatcgtgttcaggaatgttcacggctaactcaatgaactgtttaaccgaagcgctcggtttatctcaaccaggtaatggctcaatgctcgctactcacgccgaccgcgagcagctgtttattaatgcaggtaaacgtattgttgaattaacaaagcgttattatgagcaagatgatgaatcagcacttccaagaaatattgccgaccgtgctgcatttgaaaatgccatggcacttgatatcgcaatgggtggttctagtaataccgttcttcaccttttagcttctgctcaagaaggcgaaattgatttcgatatgggtgacattgatgagatgtctcgtcgagtacctcacttgtgtaaagtcgctccatcaacgcctaaatatcatatggaagatgttcaccgagcaggtggtgtaatggctatccttggtgagttagatagagctgggcttctgaataatcaaacaaaaacggttcttggcttaaccatgcaagagcaacttgcacaatacgatattatgcaaactgaagacgaagagatccttaaattcttccgtgcaggacctgcagggatccgaacaacaaaagcattctcgcaagattgccgttgggatcgccttgatgacgaccgaaaagaagggtgtattcgaaccaaagaaaatgcctttagccaagaaggtggtctcgccgttctatctggcaatatagcggttgatggttgtattgtaaaaaccgccggcgttgatgaagaaaatctaaagttccaaggtccagccattgtttttgaaagccaagactcagcggtagaaggcattttaggtggaaaagttaaagcgggtgaagtcgttgttattcgctacgaaggtccaaagggtggtccaggtatgcaagaaatgctttacccaaccacttacttgaaatcaatgggcttaggcaaagcatgtgcgcttctaactgatggtcgattctctggtggtacatcaggcctatctataggtcacgcatctccagaagctgcaagtggtggcacaataggtttagttaacgatggtgatatcattaccatcgatatcccaagccgctcaattacgcttgatgtaccagaatcagaactgcaagctcgtcgagcgaaacaagatgaactcggttggaaacctgtgaatcgtcaacgtgaagtctcttttgcattaaaagcctatgcaagtatggcaacaagtgcagataaaggtgctgttcgtgataaatctaagttagaagggtaa

SEQ ID NO: 700 - protein, 613 aa, Vibrio fisheri
MPTYRSATTTHGRNMAGARALWRATGVKEDDFGKPIIAVVNSFTQFVPGHVHLKDMGQLVAGEIEKAGGIAKEFNTIAVDDGIAMGHGGMLYSLPSRELIADSVEYMVNAHCADAMVCISNCDKITPGMMMAAMRLNIPVIFVSGGPMEAGKTKLSDQIIKLDLVDAMIQGADPTVSDAQSEQIERSACPTCGSCSGMFTANSMNCLTEALGLSQPGNGSMLATHADREQLFINAGKRIVELTKRYYEQDDESALPRNIADRAAFENAMALDIAMGGSSNTVLHLLASAQEGEIDFDMGDIDEMSRRVPHLCKVAPSTPKYHMEDVHRAGGVMAILGELDRAGLLNNQTKTVLGLTMQEQLAQYDIMQTEDEEILKFFRAGPAGIRTTKAFSQDCRWDRLDDDRKEGCIRTKENAFSQEGGLAVLSGNIAVDGCIVKTAGVDEENLKFQGPAIVFESQDSAVEGILGGKVKAGEVVVIRYEGPKGGPGMQEMLYPTTYLKSMGLGKACALLTDGRFSGGTSGLSIGHASPEAASGGTIGLVNDGDIITIDIPSRSITLDVPESELQARRAKQDELGWKPVNRQREVSFALKAYASMATSADKGAVRDKSKLEG

SEQ ID NO: 701 - DNA, 1860 bp, Shewanella oneidensis
atgccaaagttacgatcagctaccagtacggaaggccgcaatatggcgggtgcccgtgcgctatggcgcgccaccggggtgaaagacaatgattttggtaagccgattattgcgattgccaactcctttactcagtttgttcccggccatgtgcacttaaaagatatgggctcactggtggcgagtgcgattgaagaggcgggcggtatcgccaaagaattcaatactatcgccgtcgacgatggtatcgccatgggccacggtggcatgctctacagtttgccctcgcgggagctgattgccgatagtgtggagtacatggtcaatgcccactgcgccgatgccttagtgtgtatctccaactgcgacaaaatcactcccggcatgttgatggcggcgctgcgtctcaatattcccgtggtatttgtgtcgggtgggccgatggaagcgggtaaaaccaaactgtcggacaaacttatcaagctcgatttagtcgatgccatggtggcggcggccgactcgagtgtgagcgatgaagatagcgccaaaatcgagcgcagtgcttgcccgacgtgtggttcctgttcgggcatgttcaccgccaactctatgaactgtttgaccgaagccctggggttatcgctgccgggcaacggctccatgctggcaacccatagcgatcgccgcgagctgtttttagaggcgggccggcgcgtgatggcgctgaccaagcgttattacgagcaagatgacacctcggcgctgccgcgtaatatcgcctgctttaaagcttttgagaacgccaccgcattagatatcgccatgggcggttcgtctaatactgtgttgcacttgttagcggcggcgcaggaggcggaagtcgcatttactatggacgatatcgaccgtatgtcgcgccttgtgccgcacctttgtaaagtcgccccatcgacgcctaaatatcatatggaagatgtgcaccgcgccggtggcgtgatgggcattttaggcgagcttgaccgcgccggattgctgcataccgatgtgccacacgttgccgccgatgcaggcggaaatctcaagtcggtgcttgccaagtacgatgtcatgcaaacccaagatgacaacgtaaaacaattctttatggcgggacctgcgggcatccccaccactaaagcctttagtcaagactgccgctggccatcgctggatgatgacaggcgagaagggtgtatccgcagccgcgaatttgcctttagccaagaaggcgggctggccgtgctgtcgggcaatttagctgaaaatggctgtattgttaaaacggcgggcgtggatgagtcgaatttgatttttgttggctcggctcgcgtctacgaaagccaagatgatgcggtggcgggcattttaggtggcgaagtagtggcgggcgatgtggtcgtcatccgttacgaagggccaaaaggtggtccgggtatgcaagaaatgttgtaccccaccagttacttaaaatcccgcggcttaggcaaggcctgcgcgctaatcaccgatggacgtttctctggtggaacatccggtttatccatcggccatgtgtcgcccgaggcggcggctggcggcacgattgccttgattgaaaacggcgatcgcattgaaatcgatatcccagcgcgcagtattaagctcgctgtgagcgatgccgagttagcggggcgtcgtgagaccatgttagcgcgtggtccaatggcgtggaagcctgttggtcgcgagcgttttgtatctatggcactaaaagcctacgccatgcttgccaccagtgccgataagggcgcggtgcgcgatcgcagcaagttggaggactga

SEQ ID NO: 702 - protein, 619 aa, Shewanella oneidensis
MPKLRSATSTEGRNMAGARALWRATGVKDNDFGKPIIAIANSFTQFVPGHVHLKDMGSLVASAIEEAGGIAKEFNTIAVDDGIAMGHGGMLYSLPSRELIADSVEYMVNAHCADALVCISNCDKITPGMLMAALRLNIPVVFVSGGPMEAGKTKLSDKLIKLDLVDAMVAAADSSVSDEDSAKIERSACPTCGSCSGMFTANSMNCLTEALGLSLPGNGSMLATHSDRRELFLEAGRRVMALTKRYYEQDDTSALPRNIACFKAFENATALDIAMGGSSNTVLHLLAAAQEAEVAFTMDDIDRMSRLVPHLCKVAPSTPKYHMEDVHRAGGVMGILGELDRAGLLHTDVPHVAADAGGNLKSVLAKYDVMQTQDDNVKQFFMAGPAGIPTTKAFSQDCRWPSLDDDRREGCIRSREFAFSQEGGLAVLSGNLAENGCIVKTAGVDESNLIFVGSARVYESQDDAVAGILGGEVVAGDVVVIRYEGPKGGPGMQEMLYPTSYLKSRGLGKACALITDGRFSGGTSGLSIGHVSPEAAAGGTIALIENGDRIEIDIPARSIKLAVSDAELAGRRETMLARGPMAWKPVGRERFVSMALKAYAMLATSADKGAVRDRSKLED

SEQ ID NO: 703 - protein, 690 aa, Saccharomyces cerevisiae
MEGFNPADIEHASPINSSDSHSSSFVYALPKSASEYVVNHNEGRASASGNPAAVPSPIMTLNLKSTHSLNIDQHVHTSTSPTETIGHIHHVEKLNQNNLIHLDPVPNFEDKSDIKPWLQKIFYPQGIELVIERSDAFKVVFKCKAAKRGRNARRKRKDKPKGQDHEDEKSKINDDELEYASPSNATVTNGPQTSPDQTSSIKPKKKRCVSRFNNCPFRVRATYSLKRKRWSIVVMDNNHSHQLKFNPDSEEYKKFKEKLRKDNDVDAIKKFDELEYRTLANLPIPTATIPCDCGLTNEIQSFNVVLPTNSNVTSSASSSTVSSISLDSSNASKRPCLPSVNNTGSINTNNVRKPKSQCKNKDTLLKRTTMQNFLTTKSRLRKTGTPTSSQHSSTAFSGYIDDPFNLNEILPLPASDFKLNTVTNLNEIDFTNIFTKSPHPHSGSTHPRQVFDQLDDCSSILFSPLTTNTNNEFEGESDDFVHSPYLNSEADFSQILSSAPPVHHDPNETHQENQDIIDRFANSSQEHNEYILQYLTHSDAANHNNIGVPNNNSHSLNTQHNVSDLGNSLLRQEALVGSSSTKIFDELKFVQNGPHGSQHPIDFQHVDHRHLSSNEPQVRSHQYGPQQQPPQQLQYHQNQPHDGHNHEQHQTVQKDMQTHESLEIMGNTLLEEFKDIKMVNGELKYVKPED

SEQ ID NO: 704 - protein, 416 aa, Saccharomyces cerevisiae
MKAKSMKSIISVPISVSKTGKMKLTASPDNLASMMSKDQNKLIHLDPVPSFEDRHEIKPWLQKIFYPQGIDIVIERSDSSKVTFKCRSVRSKVGLNPKSKGSSSRSHACPFRIRAAYSVRLQKWNVVVMNNIHSHELRFDLITKTDDYKKFKENLRQKNDEKAIKTFDELEYKASLNLPLVTPIISCDCGLTKEIEAFNNIFLPLSNPPLTSKKNLLKTNKNSVSKIKSRQMDNSKPRPRLKTKLDADLHDTGFLDNFKTRNSCVKIEKEDSLTNLNEIDFTNMFCNDNFIQNYNQGLMELLTEPTPGPSSSSCILPSTPTRPLSQSKMDIALSESTTSSPNFMETDAPYGDEIIKVSKDTKSNAPTADTDIATNLGKERNENFGMLNYNYEALLHFNDEHFNELNSIDPALISKY

SEQ ID NO: 705 - protein, 749 aa, Saccharomyces cerevisiae
MTSKPSTSDGRAHSISHVPGTHMRGTSASHSPRPFRPCADCTCSPGLLSRQGRRASLFLRQLENSRRSSSMLLNELKGAGGGSSAGNGSVYSCDSLCAVNREVNTTDRLLKLRQEMKKHDLCCYIVPSCDEHQSEYVSLRDQRRAFISGFSGSAGVACITRDLLNFNDDHPDGKSILSTDGRYFNQARQELDYNWTLLRQNEDPITWQEWCVREALEMAKGLGNKEGMVLKIGIDPKLITFNDYVSFRKMIDTKYDAKGKVELVPVEENLVDSIWPDFETLPERPCNDLLLLKYEFHGEEFKDKKEKLLKKLNDKASSATTGRNTFIVVALDEICWLLNLRGSDIDYNPVFFSYVAINEDETILFTNNPFNDDISEYFKINGIEVRPYEQIWEHLTKITSQASSAEHEFLIPDSASWQMVRCLNTSTNANGAIAKKMTAQNFAIIHSPIDVLKSIKNDIEIKNAHKAQVKDAVCLVQYFAWLEQQLVGREALIDEYRAAEKLTEIRKTQRNFMGNSFETISSTGSNAAIIHYSPPVENSSMIDPTKIYLCDSGSQFLEGTTDITRTIHLTKPTKEEMDNYTLVLKGGLALERLIFPENTPGFNIDAIARQFLWSRGLDYKHGTGHGIGSFLNVHEGPMGVGFRPHLMNFPLRAGNIISNEPGYYKDGEYGIRIESDMLIKKATEKGNFLKFENMTVVPYCRKLINTKLLNEEEKTQINEYHARVWRTIVHFLQPQSISYKWLKRETSPL

SEQ ID NO: 706 - protein, 120 aa, Saccharomyces cerevisiae
MTGERIEKVKINDEFAKSHFLTTQWRETKRQRHYKMPVTEQGLRERIESAIPQVYHIIVTDLSYGCGQSFDIVVVSDFFQGKSKLMRSRAVNKAVKEELQEIHAFSCKCYTEEEWSKIVV

SEQ ID NO: 707 - protein, 285 aa, Saccharomyces cerevisiae
MCSFQVPSAFSFNYTSYCYKRHQARYYTAAKLFQEMPVIEINDQEQFTYLTTTAAGDKLIVLYFHTSWAEPCKALKQVFEAISNEPSNSNVSFLSIDADENSEISELFEISAVPYFIIIHKGTILKELSGADPKEYVSLLEDCKNSVNSGSSQTHTMENANVNEGSHNDEDDDDEEEEEETEEQINARLTKLVNAAPVMLFMKGSPSEPKCGFSRQLVGILREHQVRFGFFDILRDESVRQNLKKFSEWPTFPQLYINGEFQGGLDIIKESLEEDPDFLQHALQS

SEQ ID NO: 708 - protein, 244 aa, Saccharomyces cerevisiae
MTVVEIKSQDQFTQLTTTNAANKLIVLYFKAQWADPCKTMSQVLEAVSEKVRQEDVRFLSIDADEHPEISDLFEIAAVPYFVFIQNGTIVKEISAADPKEFVKSLEILSNASASLANNAKGPKSTSDEESSGSSDDEEDETEEEINARLVKLVQAAPVMLFMKGSPSEPKCGFSRQLVGILREHQIRFGFFDILRDENVRQSLKKFSDWPTFPQLYINGEFQGGLDIIKESIEEDPEYFQHALQ

SEQ ID NO: 709 - protein, 1224 aa, Saccharomyces cerevisiae
MDSTGASQIVSALDVIYSPKSNNSQRQEAQKFLDEVKLCSESPFWGYEIALQNPTNSILKYFGLGLLDHAVKKNWNDYDEGKRVALRKWVMELNFGVQDYDTRYIKEKLATLWVEVAKRTWGEALKQTNPTEEQLLTSWVDMDNNLFELWNINQSSRELALIIFRILFEDVFLLDDLIVLKRMTVIQPLCVMIVCPIEVFAIKYKFSDKWTKFKANEEGWFSVWIPELNNALQQNNSEYIIRLLETLKTCLNWPLTEVIVRNDVLSSLLTCLSSNIPRAQSMALDSIHILLTRPYSNESHYQMTIDRVFDNMDLLDSVYESLLFDPTDDIDETKYPIIKKFVDMISCLYVCVPKIKETNGQIQKYFKLVLKTTYNPSLIVSGLTLDLWCTCLRNDEYLPKLEKYVIPDLLQFAADALVYYEQIDGHISKKFAEIDFQSKSEFQTFCSTYRKRIRDIIRLISCVELDLTYDWLNNRLNNYFSSPFGQQVLSSTFLDHKLEPYLGALSQYMIVECFINGCIRWKIWYPTGDDYDEKLDSILQKLEILSNQLIALNLREPLLLKKQIQNFALFLTMLKDNVLFTLLEKIITSATMDYPEINLEERGAESDAVRDLRYACGIELNRMALLMPESLKKIYPDLESVIARIMPNLSYHEKISFKSFLLIIVLKSSLDMKEERFAAIVDPELLAWSDKTTVVGLSDLHWFMERLGIVQIAEYFQRRDIDENSDLLSIPIDDEGKELKSELTKRWQSLFPVRATRMFIHYSMQSIKTDEEFKMLQDLWRPRIVPILPYITRLLYQLQSYHDPDNWKGLPTVVQSFVKYSTIERFWEAGASNKSKDEFIDEHMKAMQTLRDFADSVGHIIRYTREYTLLVLSAISSLGSVFYLLDESPDLLLNSIAIFKPGSNEISPGVSTHGWKHIMNIAIRPILKGCPKDCLGKFMPAFLPKLFEILDLLLCQKWSSHMNDMDMNPVPTDDDQMTEEILEENLLRQLTTVVVRIVIDCVGQGNANPNSAKSRLNNHQMEMRKIIFNDLNTLAPFLKLLNHLISFKDTKCSFNSILVMKCCLTSVLNQNNTVDEYFTFEVMKNLLLNVLCNSAFKDSFHEALYAFTVIFLTLCKEYPSARAFLFEISNGYNIDELYRNLRSVDEYKTQRALMIDFIDWVKSTSGKEDGNVDHAGDERKRQEKREAILKKANERLIKKNKENGDMLDDPNIEDGAVGNLFDDN

SEQ ID NO: 710 - protein, 1089 aa, Saccharomyces cerevisiae
MSALPEEVNRTLLQIVQAFASPDNQIRSVAEKALSEEWITENNIEYLLTFLAEQAAFSQDTTVAALSAVLFRKLALKAPPSSKLMIMSKNITHIRKEVLAQIRSSLLKGFLSERADSIRHKLSDAIAECVQDDLPAWPELLQALIESLKSGNPNFRESSFRILTTVPYLITAVDINSILPIFQSGFTDASDNVKIAAVTAFVGYFKQLPKSEWSKLGILLPSLLNSLPRFLDDGKDDALASVFESLIELVELAPKLFKDMFDQIIQFTDMVIKNKDLEPPARTTALELLTVFSENAPQMCKSNQNYGQTLVMVTLIMMTEVSIDDDDAAEWIESDDTDDEEEVTYDHARQALDRVALKLGGEYLAAPLFQYLQQMITSTEWRERFAAMMALSSAAEGCADVLIGEIPKILDMVIPLINDPHPRVQYGCCNVLGQISTDFSPFIQRTAHDRILPALISKLTSECTSRVQTHAAAALVNFSEFASKDILEPYLDSLLTNLLVLLQSNKLYVQEQALTTIAFIAEAAKNKFIKYYDTLMPLLLNVLKVNNKDNSVLKGKCMECATLIGFAVGKEKFHEHSQELISILVALQNSDIDEDDALRSYLEQSWSRICRILGDDFVPLLPIVIPPLLITAKATQDVGLIEEEEAANFQQYPDWDVVQVQGKHIAIHTSVLDDKVSAMELLQSYATLLRGQFAVYVKEVMEEIALPSLDFYLHDGVRAAGATLIPILLSCLLAATGTQNEELVLLWHKASSKLIGGLMSEPMPEITQVYHNSLVNGIKVMGDNCLSEDQLAAFTKGVSANLTDTYERMQDRHGDGDEYNENIDEEEDFTDEDLLDEINKSIAAVLKTTNGHYLKNLENIWPMINTFLLDNEPILVIFALVVIGDLIQYGGEQTASMKNAFIPKVTECLISPDARIRQAASYIIGVCAQYAPSTYADVCIPTLDTLVQIVDFPGSKLEENRSSTENASAAIAKILYAYNSNIPNVDTYTANWFKTLPTITDKEAASFNYQFLSQLIENNSPIVCAQSNISAVVDSVIQALNERSLTEREGQTVISSVKKLLGFLPSSDAMAIFNRYPADIMEKVHKWFA

SEQ ID NO: 711 - protein, 261 aa, Saccharomyces cerevisiae
MTQEFIDKVSSYLTPDVDIAPISQGAEAIVFTTTTHPYLPRAKDSHQKYIIKYRPPKRYRHPQIDQALTKHRTLNESRLLAKLYLIPGLCVPQLIACDPYNGFIWLEFLGEDLPGGHGFSNLKNFLWMHDQDPYSDLVATTLRKVGRQIGLLHWNDYCHGDLTSSNIVLVRDGARWTPHLIDFGLGSVSNLVEDKGVDLYVLERAILSTHSKHAEKYNAWIMEGFEEVYREQGAKGAKKLKEVTKRFEEVRLRGRKRSMLG

SEQ ID NO: 712 - protein, 118 aa, Saccharomyces cerevisiae
MKLPQTMLRSISVKHVRWPRILTGSKLWYSTQMAMTPEEKMITDKLQQELEPEVCKVQDVSGGCGSMFAINITSKKFNGLSLIKQHQLVNRILRDDISRWHGLQLTTKKSTGKGPASS

SEQ ID NO: 713 - protein, 486 aa, Saccharomyces cerevisiae
MSEQKEDLFKPVGEAAAEVEDESIAEQNKANDGVKLTGAQDAMGHPVQEIESLCMNCGKNGTTRLLLTSIPYFREIIIMSFDCPHCGFKNCEIQPASQIQEKGSRYVLKVECREDFNRQVIKSETATCKFVELDIEIPAKRGQLTTVEGLLSEMIDDLSQDQEMRKSIDEALYKKIDDFIQKVKSYINCEPNTIPITFILDDPAGNSWIEYKPGEPQHKWSHTQYVRTDEQNVQVGIITRDQLEQRRQEQLKQLANRERNPSESVKVGSANPQFLSDATDIENFNNEVQTFRASCPSCTQECETHMKPVNIPHFKEVIIMSTVCDHCGYKSNEVKTGGAIPDKGRRITLYCDDAADLSRDILKSETCSMVIPELHLDIQEGTLGGRFTTLEGLLRQVYEELESRIFTQTSDSMDEATKARWVEFFAKLKEAIAGKVKFTVIMEDPLAGSYIQNVYAPDPDPNMTIEDYERTKEQNEDLGLSDIKVE

SEQ ID NO: 714 - protein, 348 aa, Saccharomyces cerevisiae
MSQYKTGLLLIHPAVTTTPELVENTKAQAASKKVKFVDQFLINKLNDGSITLENAKYETVHYLTPEAQTDIKFPKKLISVLADSLKPNGSLIGLSDIYKVDALINGFEIINEPDYCWIKMDSSKLNQTVSIPLKKKKTNNTKLQSGSKLPTFKKASSSTSNLPSFKKADHSRQPIVKETDSFKPPSFKMTTEPKVYRVVDDLIEDSDDDDFSSDSSKAQYFDQVDTSDDSIEEEELIDEDGSGKSMITMITCGKSKTKKKKACKDCTCGMKEQEENEINDIRSQQDKVVKFTEDELTEIDFTIDGKKVGGCGSCSLGDAFRCSGCPYLGLPAFKPGQPINLDSISDDL

SEQ ID NO: 715 - protein, 445 aa, Saccharomyces cerevisiae
MSHDGKEEPGIAKKINSVDDIIIKCQCWVQKNDEERLAEILSINTRKAPPKFYVHYVNYNKRLDEWITTDRINLDKEVLYPKLKATDEDNKKQKKKKATNTSETPQDSLQDGVDGFSRENTDVMDLDNLNVQGIKDENISHEDEIKKLRTSGSMTQNPHEVARVRNLNRIIMGKYEIEPWYFSPYPIELTDEDFIYIDDFTLQYFGSKKQYERYRKKCTLRHPPGNEIYRDDYVSFFEIDGRKQRTWCRNLCLLSKLFLDHKTLYYDVDPFLFYCMTRRDELGHHLVGYFSKEKESADGYNVACILTLPQYQRMGYGKLLIEFSYELSKKENKVGSPEKPLSDLGLLSYRAYWSDTLITLLVEHQKEITIDEISSMTSMTTTDILHTAKTLNILRYYKGQHIIFLNEDILDRYNRLKAKKRRTIDPNRLIWKPPVFTASQLRFAW

SEQ ID NO: 716 - protein, 226 aa, Saccharomyces cerevisiae
MSANLDKSLDEIIGSNKAGSNRARVGGTRGNGPRRVGKQVGSQRRSLPNRRGPIRKNTRAPPNAVARVAKLLDTTREVKVNVEGLPRDIKQDAVREFFASQVGGVQRVLLSYNERGQSTGMANITFKNGELARRAVERFNGSPIDGGRSRLRLNLIVDPNQRPVKSLADRIKAMPQKGGNAPRPVKRGPNRKAAMAKSQNKPKREKPAKKSLEDLDKEMADYFEKK

SEQ ID NO: 717 - protein, 446 aa, Saccharomyces cerevisiae
MDDKVSEKESSPKQTEEDSEGKMAHVQPASYVNKKKYVFGKTLGAGTFGVVRQAKNTETGEDVAVKILIKKALKGNKVQLEALYDELDILQRLHHPNIVAFKDWFESKDKFYIITQLAKGGELFDRILKKGKFTEEDAVRILVEILSAVKYMHSQNIVHRDLKPENLLYIDKSDESPLVVADFGIAKRLKSDEELLYKPAGSLGYVAPEVLTQDGHGKPCDIWSIGVITYTLLCGYSAFRAERVQDFLDECTTGEYPVKFHRPYWDSVSNKAKQFILKALNLDPSKRPTAAELLEDPWIICTELKTHNLLPGLKEGLDARQKFRNSVERVRLNMKIQKLRDLYLEQTESDSDFDEGSQANGSVPPLKATDTSQLSKKLSEEEQSKLKSELTSKAFAQLVNTVLAEKEKFLNINRVCSSDSDLPGSDIKSLDEAKEKPEGKDTKTEE

SEQ ID NO: 718 - protein, 713 aa, Saccharomyces cerevisiae
MTASVSNTQNKLNELLDAIRQEFLQVSQEANTYRLQNQKDYDFKMNQQLAEMQQIRNTVYELELTHRKMKDAYEEEIKHLKLGLEQRDHQIASLTVQQQRQQQQQQQVQQHLQQQQQQLAAASASVPVAQQPPATTSATATPAANTTTGSPSAFPVQASRPNLVGSQLPTTTLPVVSSNAQQQLPQQQLQQQQLQQQQPPPQVSVAPLSNTAINGSPTSKETTTLPSVKAPESTLKETEPENNNTSKINDTGSATTATTTTATETEIKPKEEDATPASLHQDHYLVPYNQRANHSKPIPPFLLDLDSQSVPDALKKQTNDYYILYNPALPREIDVELHKSLDHTSVVCCVKFSNDGEYLATGCNKTTQVYRVSDGSLVARLSDDSAANNHRNSITENNTTTSTDNNTMTTTTTTTITTTAMTSAAELAKDVENLNTSSSPSSDLYIRSVCFSPDGKFLATGAEDRLIRIWDIENRKIVMILQGHEQDIYSLDYFPSGDKLVSGSGDRTVRIWDLRTGQCSLTLSIEDGVTTVAVSPGDGKYIAAGSLDRAVRVWDSETGFLVERLDSENESGTGHKDSVYSVVFTRDGQSVVSGSLDRSVKLWNLQNANNKSDSKTPNSGTCEVTYIGHKDFVLSVATTQNDEYILSGSKDRGVLFWDKKSGNPLLMLQGHRNSVISVAVANGSPLGPEYNVFATGSGDCKARIWKYKKIAPN

SEQ ID NO: 719 - protein, 506 aa, Saccharomyces cerevisiae
MESTAIVPKGPVVGSEDMEKAEVIASGSTDIISTTSTATTTAAIGSVQEESVKQEDVPMEGGEGEVEEEEGETRCICGELDTPDDSGFFIQCEQCSSWQHGYCVSITQDNAPDKYWCEQCRPELHQLFTTDTGEARSIYKPVQEKRRQSRRKARSAAASKSHAANEAEKSPRNTSNTDDNVDDIGDEEDEVEDEASAVALAKDGNTRSSRRRRRNSMDDASTDQYSLDPGDSDKKLLDRKRATFMAREEKQYQRMLEKALKESRRTSHQEDPESYENDADIYQGDTDNHNGTTRLQTDVMLTEGKPDSVTNDDMKESLRPSKEQSMEKTNDVEKEASQEKESSTGSAQDTEKTDEPILPLTSISSSEDDSRKASSRGSKRVSKPARKGNRTRRSNTSSDTNQNRRSADIGTDKPVKPRLPPQRTSLNEMRRRVSAILEFISRTQWELSEDQSDREEFVRFVENQHFVEKVDTIYNGYNESLSMMDDLTRELLLWEKKYSNNTNAIQ

SEQ ID NO: 720 - protein, 966 aa, Saccharomyces cerevisiae
MNPGGEQTIMEQPAQQQQQQQQQQQQQQQQAAVPQQPLDPLTQSTAETWLSIASLAETLGDGDRAAMAYDATLQFNPSSAKALTSLAHLYRSRDMFQRAAELYERALLVNPELSDVWATLGHCYLMLDDLQRAYNAYQQALYHLSNPNVPKLWHGIGILYDRYGSLDYAEEAFAKVLELDPHFEKANEIYFRLGIIYKHQGKWSQALECFRYILPQPPAPLQEWDIWFQLGSVLESMGEWQGAKEAYEHVLAQNQHHAKVLQQLGCLYGMSNVQFYDPQKALDYLLKSLEADPSDATTWYHLGRVHMIRTDYTAAYDAFQQAVNRDSRNPIFWCSIGVLYYQISQYRDALDAYTRAIRLNPYISEVWYDLGTLYETCNNQLSDALDAYKQAARLDVNNVHIRERLEALTKQLENPGNINKSNGAPTNASPAPPPVILQPTLQPNDQGNPLNTRISAQSANATASMVQQQHPAQQTPINSSATMYSNGASPQLQAQAQAQAQAQAQAQAQAQAQAQAQAQAQAQAQAQAQAQAQAQAHAQAQAQAQAQAQAQAQAQAQQQQQQQQQQQQQQQQQQQQQQQQQQQQQQQLQPLPRQQLQQKGVSVQMLNPQQGQPYITQPTVIQAHQLQPFSTQAMEHPQSSQLPPQQQQLQSVQHPQQLQGQPQAQAPQPLIQHNVEQNVLPQKRYMEGAIHTLVDAAVSSSTHTENNTKSPRQPTHAIPTQAPATGITNAEPQVKKQKLNSPNSNINKLVNTATSIEENAKSEVSNQSPAVVESNTNNTSQEEKPVKANSIPSVIGAQEPPQEASPAEEATKAASVSPSTKPLNTEPESSSVQPTVSSESSTTKANDQSTAETIELSTATVPAEASPVEDEVRQHSKEENGTTEASAPSTEEAEPAASRDAEKQQDETAATTITVIKPTLETMETVKEEAKMREEEQTSQEKSPQENTLPRENVVRQVEEDENYDD

SEQ ID NO: 721 - protein, 93 aa, Saccharomyces cerevisiae
MVTPREPKKRTTRKKKDPNAPKRALSAYMFFANENRDIVRSENPDITFGQVGKKLGEKWKALTPEEKQPYEAKAQADKKRYESEKELYNATLA

SEQ ID NO: 722 - protein, 99 aa, Saccharomyces cerevisiae
MAATKEAKQPKEPKKRTTRRKKDPNAPKRRLSAYMFFANENRDIVRSENPDVTFGQVGRILGERWKALTAEEKQPYESKAQADKKRYESEKELYNATRA

SEQ ID NO: 723 - protein, 706 aa, Saccharomyces cerevisiae
MDSVMVKKEVLENPDHDLKRKLEENKEEENSLSTTSKSKRQVIVPVCMPKIHYSPLKTGLCYDVRMRYHAKIFTSYFEYIDPHPEDPRRIYRIYKILAENGLINDPTLSGVDDLGDLMLKIPVRAATSEEILEVHTKEHLEFIESTEKMSREELLKETEKGDSVYFNNDSYASARLPCGGAIEACKAVVEGRVKNSLAVVRPPGHHAEPQAAGGFCLFSNVAVAAKNILKNYPESVRRIMILDWDIHHGNGTQKSFYQDDQVLYVSLHRFEMGKYYPGTIQGQYDQTGEGKGEGFNCNITWPVGGVGDAEYMWAFEQVVMPMGREFKPDLVIISSGFDAADGDTIGQCHVTPSCYGHMTHMLKSLARGNLCVVLEGGYNLDAIARSALSVAKVLIGEPPDELPDPLSDPKPEVIEMIDKVIRLQSKYWNCFRRRHANSGCNFNEPINDSIISKNFPLQKAIRQQQQHYLSDEFNFVTLPLVSMDLPDNTVLCTPNISESNTIIIVVHDTSDIWAKRNVISGTIDLSSSVIIDNSLDFIKWGLDRKYGIIDVNIPLTLFEPDNYSGMITSQEVLIYLWDNYIKYFPSVAKIAFIGIGDSYSGIVHLLGHRDTRAVTKTVINFLGDKQLKPLVPLVDETLSEWYFKNSLIFSNNSHQCWKENESRKPRKKFGRVLRCDTDGLNNIIEERFEEATDFILDSFEEWSDEE

SEQ ID NO: 724 - protein, 409 aa, Saccharomyces cerevisiae
MGNILRKGQQIYLAGDMKKQMLLNKDGTPKRKVGRPGRKRIDSEAKSRRTAQNRAAQRAFRDRKEAKMKSLQERVELLEQKDAQNKTTTDFLLCSLKSLLSEITKYRAKNSDDERILAFLDDLQEQQKRENEKGTSTAVSKAAKELPSPNSDENMTVNTSIEVQPHTQENEKVMWNIGSWNAPSLTNSWDSPPGNRTGAVTIGDESINGSEMPDFSLDLVSNDRQTGLEALDYDIHNYFPQHSERLTAEKIDTSACQCEIDQKYLPYETEDDTLFPSVLPLAVGSQCNNICNRKCIGTKPCSNKEIKCDLITSHLLNQKSLASVLPVAASHTKTIRTQSEAIEHISSAISNGKASCYHILEEISSLPKYSSLDIDDLCSELIIKAKCTDDCKIVVKARDLQSALVRQLL

SEQ ID NO: 725 - protein, 528 aa, Saccharomyces cerevisiae
MKLSSAFVLSAITVAALGESITTTITATKNGHVYTKTVTQDATFVWAGEGAAVTSAVTEASTVAATSAAAETSVAAETSIVEPSTSAQGTSADEGSGSSITTTITATKNGHVYTKTVTQDATFVWTGEGERAPASTVATVETSVAAETSVAEPSTSAQGTSADEGSGSSITTTITATKNGHVYTKTVTQDATFVWTGEGERAPVSTVATVETAASPVTSVAEPSASTDEGSGSSITTTITATKNGHVYTKTVTQDATFVWTGEGERAPASTVATSSISAIEIPSTTEASIVEASSAVETSSAAETSSAVETSSAVETSSAVETSSAAETSSAAETSSAVETSSAVEISSAVETSAVETSSSSSTIETTSVKSLSPTQTSLSSSVQASSPIETSSAAKTSSVVPTFSSTTTENSSNSKSTSAVVASTTTSSESSATIVTPTRIGQAYTESSSRDAQSVRTHESNNWSSSSSASTKMVSSITRVQTTTAGIFTNGKSSTTPQIVNYTGAADSIAAGTGLMGAALAAVIFL

SEQ ID NO: 726 - protein, 153 aa, Saccharomyces cerevisiae
MKFSTIFGATTVMTAVSAAAVSSVMTTKTITATNGNNVYTKVVTDTADPIISYSTTRTVVVSNSDATYTKVVTEGPDTTSEKSTTKTLTLTNGSGSSTNLYTKTVTQAVESSTSSSSSSSSSSSSASSSGAAPAAFQGASVGALALGLISYLL

SEQ ID NO: 727 - protein, 204 aa, Saccharomyces cerevisiae
MKFSSALVLSAVAATALAESITTTITATKNGHVYTKTVTQDATFVWGGEDSYASSTSAAESSAAETSAAETSAAATTSAAATTSAAETSSAAETSSADEGSGSSITTTITATKNGHVYTKTVTQDATFVWTGEGSSNTWSPSSTSTSSEAATSSASTTATTTAETSSSATSSSTAELSSYTGAADAITAGTGLMGAALAAVMLL

SEQ ID NO: 728 - protein, 686 aa, Saccharomyces cerevisiae
MVRTRVLFCLFISFFATVQSSATLISTSCISQAALYQFGCSSKSKSCYCKNINWLGSVTACAYENSKSNKTLDSALMKLASQCSSIKVYTLEDMKNIYLNASNYLRAPEKSDKKTVVSQPLMANETAYHYYYEENYGIHLNLMRSQWCAWGLVFFWVAVLTAATILNILKRVFGKNIMANSVKKSLIYPSVYKDYNERTFYLWKRLPFNFTTRGKGLVVLIFVILTILSLSFGHNIKLPHPYDRPRWRRSMAFVSRRADLMAIALFPVVYLFGIRNNPFIPITGLSFSTFNFYHKWSAYVCFMLAVVHSIVMTASGVKRGVFQSLVRKFYFRWGIVATILMSIIIFQSEKVFRNRGYEIFLLIHKAMNIMFIIAMYYHCHTLGWMGWIWSMAGILCFDRFCRIVRIIMNGGLKTATLSTTDDSNVIKISVKKPKFFKYQVGAFAYMYFLSPKSAWFYSFQSHPFTVLSERHRDPNNPDQLTMYVKANKGITRVLLSKVLSAPNHTVDCKIFLEGPYGVTVPHIAKLKRNLVGVAAGLGVAAIYPHFVECLRLPSTDQLQHKFYWIVNDLSHLKWFENELQWLKEKSCEVSVIYTGSSVEDTNSDESTKGFDDKEESEITVECLNKRPDLKELVRSEIKLSELENNNITFYSCGPATFNDDFRNAVVQGIDSSLKIDVELEEESFTW

SEQ ID NO: 729 - protein, 711 aa, Saccharomyces cerevisiae
MHWTSILSAILLFCLSGARASPAKTVIRNKVPLLVTNACTRIFQKVTWEYTSKSKRSSPVCSYEPAFQSMLYCIYETLDEKGYSNKTLEKTFSTIKKNCASYSDALQNMTNSEFYDVLNNGTRHMTPYVKGSANLTYPVEMDTQLRKAYYHALHGFYANLDVGNIYGGIICAYFVAIMAFAGVLHCMNYTPFKTVLLKQKLVGYVRGYLTLPTIGSKHASDFSYFRIFTGYLPTRLEGIIILGYLVLHTVFLAYGYEYDPENIIFKSRRVQVARYVADRSGVLAFAHFPLIVLFAGRNNFLEYISGVKYTSFIMFHKWLGRMMFLDAMIHGSAYTSYTVANKTWATSKNRLYWQFGVAALCLAGTMVFFSFAVFRKYFYEAFLFLHIVLGAMFFYACWEHVVSLSGIEWIYTAIAIWIVDRIIRIIKASYFGFPKASLQLIGDDLIRLTVKKPARPWRAKPGQYVFVSFLHPLYFWQSHPFTVLDSVSKNGELVIILKEKKGVTRLVKKYVCRNGGKTSMRLAIEGPYGSSSPVNNYNNVLLLTGGTGLPGPIAHAIKLGKTSAAAGKQSVKLVIAVRGFDVLEAYKPELMCLENLNVQLHIYNTMEVPSLTPSDSLDISQQDEKADEKGTVVATTLEKSANPLGFDGVVFHCGRPNVKELLHEAAELSGSLSVVCCGPPIFVDKVRNETAKIVLDKSAKAIEYFEEYQCW

SEQ ID NO: 730 - protein, 711 aa, Saccharomyces cerevisiae
MYWVLLCGSILLCCLSGASASPAKTKMYGKLPLVLTDACMGVLGEVTWEYSSDDLYSSPACTYEPALQSMLYCIYESLNEKGYSNRTFEKTFAAIKEDCAYYTDNLQNMTNADFYNMLNNGTTYIIQYSEGSANLTYPIEMDAQVRENYYYSYHGFYANYDIGHTYGGIICAYFVGVMILASILHYLSYTPFKTALFKQRLVRYVRRYLTIPTIWGKHASSFSYLKIFTGFLPTRSEGVIILGYLVLHTVFLAYGYQYDPYNLIFDSRREQIARYVADRSGVLAFAHFPLIALFAGRNNFLEFISGVKYTSFIMFHKWLGRMMFLDAVIHGAAYTSYSVFYKDWAASKEETYWQFGVAALCIVGVMVFFSLAMFRKFFYEAFLFLHIVLGALFFYTCWEHVVELSGIEWIYAAIAIWTIDRLIRIVRVSYFGFPKASLQLVGDDIIRVTVKRPVRLWKAKPGQYVFVSFLHHLYFWQSHPFTVLDSIIKDGELTIILKEKKGVTKLVKKYVCCNGGKASMRLAIEGPYGSSSPVNNYDNVLLLTGGTGLPGPIAHAIKLGKTSAATGKQFIKLVIAVRGFNVLEAYKPELMCLEDLNVQLHIYNTMEVPALTPNDSLEISQQDEKADGKGVVMATTLEQSPNPVEFDGTVFHHGRPNVEKLLHEVGDLNGSLAVVCCGPPVFVDEVRDQTANLVLEKPAKAIEYFEEYQSW

SEQ ID NO: 731 - protein, 719 aa, Saccharomyces cerevisiae
MLLVHIISFLLFFQLSAAKAPPSKTSLINTHERRSIYSCYVGLRKETWGFNGSAICRYEPAIQSMLYCLYEDTHEKGYSNKTLEKGFEEMRQFCYTPKFLNMTDAEFYTSLDNGTYYIQDQPKAGINITYPIRLNTTLRKAYYDAYYGYYYNHDIPYYFGGIICAYFVGVMLLAGLIRFLNYTPIKKIMFQQKLVNYVRGYTTLPTLYEKHAEPFSYLKVITGYLPTRFETLVILGYLILHTIFMAYKYQYDPYHIIFAAHRAEVAHFVAYRSGILSFAHLPLIVLFAGRNNFLQLISGLKHTSFIVFHKWLGRMMFLDAIIHAAGFTNYYLYYKKWNTVRLRVYWKFGIATTCLAGMLIFFSIAAFRRHYYETFMALHIVFAALFLYTCWEHVTNFSGIEWIYAAIAIWGVDRIVRITRIALLGFPKADLQLVGSDLVRVTVKKPKKFWKAKPGQYVFVSFLRPLCFWQSHPFTVMDSCVNDRELVIVLKAKKGVTKLVRNFVERKGGKASMRLAIEGPYGSKSTAHRFDNVLLLAGGSGLPGPISHALELGKTTAASGKNFVQLVIAVRGLDMLNACKKELMALKGLNVQVHIYNSKQELASAEKISSNEVKNGETTAEKAPSSLSNSEKAPSESENTELPLSLNDTSISDLEFATFHVGRPNVEEILNESVNHSGSLAVVCCGPPIFVDTARNQTAKAVIRNPSRMIEYLEEYQAW

SEQ ID NO: 732 - protein, 694 aa, Saccharomyces cerevisiae
MLFARLVLLLVYLAPGSLAKPASTKKRTQWDQIAIDACAKELESHKFDTDVKGRHATLCTYEPALGSWLHCAKDVLDSRKKSKKIFEKTFSKINQYCHDYHKDEVVSNEEYYRIFANASLFIRPLDEVKENIRYPVTPNKASLDRWVWAYFGPLDNIDKGNVYGVTICLYWIGVLFIAAVYHFLNFSRLKQTVFKNKVSAFLRGHYVLPALVHNHAMSVGRWFFIGLVPTRLETLVLFGYVLLHGFLLSSYNFDHNELLSDRRSQVLIFLSDRAGILAFAHFPLIVLFGGKNSTMTWLTGIRYTAFITYHKWLGRFMLVDCTIHAIGYTYHAYIENYWKYVKYSDLWTSGRHAMIIVGILVFFSFFFFRRHYYELFVITHIILAIGFFHACWKHCYKLGWGEWIMACALFWIADRILRLIKIAIFGMPWAKLKLCGESMIEVRISKSSKWWKAEPGQYIYLYFLRPKIFWQSHPFTVMDSLVEDGELVVVITVKNGLTKKLQEYLLESEGYTEMRVLAEGPYGQSTRTHLFESLLFIAGGAGVPGPLSMAIKAGRQVKSNDSHQMIKFVWSVRNLDLLEVYRKEIMVLKELNIDTKIYFTGERKDESNTEEGAIANMSTEGRLLTTSKSAEMITDFGRPNIDEIIEEAVSGAKSLLVTCCGSEGFVDKTRELTAKRVLEHGDKWIEYVEEFQNW

SEQ ID NO: 733 - protein, 636 aa, Saccharomyces cerevisiae
MTNALLSIAVLLFSMLSLAQAETHTFNWTTGWDYRNVDGLKSRPVITCNGQFPWPDITVNKGDRVQIYLTNGMNNTNTSMHFHGLFQNGTASMDGVPFLTQCPIAPGSTMLYNFTVDYNVGTYWYHSHTDGQYEDGMKGLFIIKDDSFPYDYDEELSLSLSEWYHDLVTDLTKSFMSVYNPTGAEPIPQNLIVNNTMNLTWEVQPDTTYLLRIVNVGGFVSQYFWIEDHEMTVVEIDGITTEKNVTDMLYITVAQRYTVLVHTKNDTDKNFAIMQKFDDTMLDVIPSDLQLNATSYMVYNKTAALPTQNYVDSIDNFLDDFYLQPYEKEAIYGEPDHVITVDVVMDNLKNGVNYAFFNNITYTAPKVPTLMTVLSSGDQANNSEIYGSNTHTFILEKDEIVEIVLNNQDTGTHPFHLHGHAFQTIQRDRTYDDALGEVPHSFDPDNHPAFPEYPMRRDTLYVRPQSNFVIRFKADNPGVWFFHCHIEWHLLQGLGLVLVEDPFGIQDAHSQQLSENHLEVCQSCSVATEGNAAANTLDLTDLTGENVQHAFIPTGFTKKGIIAMTFSCFAGILGIITIAIYGMMDMEDATEKVIRDLHVDPEVLLNEVDENEERQVNEDRHSTEKHQFLTKAKRFF

SEQ ID NO: 734 - protein, 404 aa, Saccharomyces cerevisiae
MPNKVFNVAVFFVVFRECLEAVIVISVLLSFLKQAIGEHDRALYRKLRIQVWVGVLLGFIICLAIGAGFIGAYYSLQKDIFGSAEDLWEGIFCMIATIMISMMGIPMLRMNKMQSKWRVKIARSLVEIPHRKRDYFKIGFLSRRYAMFLLPFITVLREGLEAVVFVAGAGITTQGSHASAYPLPVVVGLICGGLVGYLLYYGASKSSLQIFLILSTSILYLISAGLFSRGAWYFENYRFNLASGGDASEGGDGNGSYNIRKAVYHVNCCNPELDNGWDIFNALLGWQNTGYLSSMLCYNIYWLVLIIVLSLMIFEERRGHLPFTKNLQLKHLNPGYWIKNKKKQELTEEQKRQLFAKMENINFNEDGEINVQENYELPEQTTSHSSSQNVATDKEVLHVKADSL

SEQ ID NO: 735 - protein, 73 aa, Saccharomyces cerevisiae
MAEIKHYQFNVVMTCSGCSGAVNKVLTKLEPDVSKIDISLEKQLVDVYTTLPYDFILEKIKKTGKEVRSGKQL

SEQ ID NO: 736 - protein, 1004 aa, Saccharomyces cerevisiae
MREVILAVHGMTCSACTNTINTQLRALKGVTKCDISLVTNECQVTYDNEVTADSIKEIIEDCGFDCEILRDSEITAISTKEGLLSVQGMTCGSCVSTVTKQVEGIEGVESVVVSLVTEECHVIYEPSKTTLETAREMIEDCGFDSNIIMDGNGNADMTEKTVILKVTKAFEDESPLILSSVSERFQFLLDLGVKSIEISDDMHTLTIKYCCNELGIRDLLRHLERTGYKFTVFSNLDNTTQLRLLSKEDEIRFWKKNSIKSTLLAIICMLLYMIVPMMWPTIVQDRIFPYKETSFVRGLFYRDILGVILASYIQFSVGFYFYKAAWASLKHGSGTMDTLVCVSTTCAYTFSVFSLVHNMFHPSSTGKLPRIVFDTSIMIISYISIGKYLETLAKSQTSTALSKLIQLTPSVCSIISDVERNETKEIPIELLQVNDIVEIKPGMKIPADGIITRGESEIDESLMTGESILVPKKTGFPVIAGSVNGPGHFYFRTTTVGEETKLANIIKVMKEAQLSKAPIQGYADYLASIFVPGILILAVLTFFIWCFILNISANPPVAFTANTKADNFFICLQTATSVVIVACPCALGLATPTAIMVGTGVGAQNGVLIKGGEVLEKFNSITTFVFDKTGTLTTGFMVVKKFLKDSNWVGNVDEDEVLACIKATESISDHPVSKAIIRYCDGLNCNKALNAVVLESEYVLGKGIVSKCQVNGNTYDICIGNEALILEDALKKSGFINSNVDQGNTVSYVSVNGHVFGLFEINDEVKHDSYATVQYLQRNGYETYMITGDNNSAAKRVAREVGISFENVYSDVSPTGKCDLVKKIQDKEGNNKVAVVGDGINDAPALALSDLGIAISTGTEIAIEAADIVILCGNDLNTNSLRGLANAIDISLKTFKRIKLNLFWALCYNIFMIPIAMGVLIPWGITLPPMLAGLAMAFSSVSVVLSSLMLKKWTPPDIESHGISDFKSKFSIGNFWSRLFSTRAIAGEQDIESQAGLMSNEEVL

SEQ ID NO: 737 - protein, 779 aa, Saccharomyces cerevisiae
MPTTYVPINQPIGDGEDVIDTNRFTNIPETQNFDQFVTIDKIAEENRPLSVDSDREFLNSKYRHYREVIWDRAKTFITLSSTAIVIGCIAGFLQVFTETLVNWKTGHCQRNWLLNKSFCCNGVVNEVTSTSNLLLKRQEFECEAQGLWIAWKGHVSPFIIFMLLSVLFALISTLLVKYVAPMATGSGISEIKVWVSGFEYNKEFLGFLTLVIKSVALPLAISSGLSVGKEGPSVHYATCCGYLLTKWLLRDTLTYSSQYEYITAASGAGVAVAFGAPIGGVLFGLEEIASANRFNSSTLWKSYYVALVAITTLKYIDPFRNGRVILFNVTYDRDWKVQEIPIFIALGIFGGLYGKYISKWNINFIHFRKMYLSSWPVQEVLFLATLTALISYFNEFLKLDMTESMGILFHECVKNDNTSTFSHRLCQLDENTHAFEFLKIFTSLCFATVIRALLVVVSYGARVPAGIFVPSMAVGATFGRAVSLLVERFISGPSVITPGAYAFLGAAATLSGITNLTLTVVVIMFELTGAFMYIIPLMIVVAITRIILSTSGISGGIADQMIMVNGFPYLEDEQDEEEEETLEKYTAEQLMSSKLITINETIYLSELESLLYDSASEYSVHGFPITKDEDKFEKEKRCIGYVLKRHLASKIMMQSVNSTKAQTTLVYFNKSNEELGHRENCIGFKDIMNESPISVKKAVPVTLLFRMFKELGCKTIIVEESGILKGLVTAKDILRFKRIKYREVHGAKFTYNEALDRRCWSVIHFIIKRFTTNRNGNVI

SEQ ID NO: 738 - protein, 627 aa, Saccharomyces cerevisiae
MESVHSRDPVKEEKKHVFMGMEHELNPETHNDSNSDSYGLPQLSEKYNALRQNRSLIIQQTEIIGSAYNKWYLQAILLLSAFICGYGYGLDGNIRYIYTGYATSSYSEHSLLSTINVINAVVSAASQIIYARLSDVFGRLYLFISAVILYVVGTIIQSQAYDVQRYAAGAIFYNAGYVGVILILLIILSDFSSLKWRLLYQFVPTWPFIINTWIAGNITSRANPVVNWSWDVGMWAFIFPLSCVPIVLCMLHMQWRARKTPEWHALKGQKSYYQEHGFIKILKQLFWMLDVVGVLLMGCSLGCILVPLTLAGGVKTTWNDSRLIGPFVLGFVLIPILWIWEYRFARDPILPYRLVKDRAVWSSMGISFLIDFIYYMAADYLYTVMIVAVNESVKSATRIATLSSFVSTVASPFFALLVTRCTRLKPFIMFGCALWMVAMGLLYHFRGGSQSHSGIIGALCVWGVGTTLFTYPVTVSVQSAVSHENMATVTALNYTLYRIGSAVGSAVSGAIWTQTLYKQILKRMGDVALATTAYESPYTFIETYTWGTPQRNALMNAYKYVQRLETIVALVFCVPLIAFSLCLRDPKLTDTVAVEYIEDGEYVDTKDNDPILDWFEKLPSKFTFKRE

SEQ ID NO: 739 - protein, 637 aa, Saccharomyces cerevisiae
MIEVPEDNRSSQTKRKNTEKNCNELMVDEKMDDDSSPRDEMKDKLKGTKSLIIRKSELMAKKYDTWQLKAIFLFSAFICTFAYGLDSSIRGTYMTYAMNSYSAHSLISTVSVIVLMISAVSQVIFGGLSDIFGRLTLFLVSIVLYIVGTIIQSQAYDVQRYAAGAVFYYVGLVGVMLQVVLMLSDNSSLKWRLFYTLIPSWPSIITTWVSGSVVEAANPLENWSWNIAMWAFIFPLCCIPLILCMLHMRWKVRNDVEWKELQDEKSYYQTHGLVQMLVQLFWKLDVVGVLLFTAGVGCILVPLTLAGGVSTNWRNSKIIGPFVLGFVLVPGFIYWESRLALVPFAPFKLLKDRGVWAPLGIMFFICFVYQMAAGYLYTILVVAVDESASSATRIINLYSFVTAVVAPFLGLIVTRSSRLKSYIIFGGSLYFITMGLFYRYRSGQDADGGIIAGMVIWGLSSCLFDYPTIVSIQSVTSHENMATVTALNYTVFRIGGAVAAAISGAIWTQSLYPKLLHYMGDADLATAAYGSPLTFILSNPWGTPVRSAMVEAYRHVQKYEVIVALVFSAPMFLLTFCVRDPRLTEDFAQKLPDREYVQTKEDDPINDWIAKRFAKALGGHKKDLQNPNRICVRKNDL

SEQ ID NO: 740 - protein, 628 aa, Saccharomyces cerevisiae
MDPGIANHTLPEEFEEVVVPEMLEKEVGAKVDVKPTLTTSSPAPSYIELIDPGVHNIEIYAEMYNRPIYRVALFFSLFLIAYAYGLDGNIRYTFQAYATSSYSQHSLLSTVNCIKTVIAAVGQIFFARLSDIFGRFSIMIVSIIFYSMGTIIESQAVNITRFAVGGCFYQLGLTGIILILEVIASDFSNLNWRLLALFIPALPFIINTWISGNVTSAIDANWKWGIGMWAFILPLACIPLGICMLHMRYLARKHAKDRLKPEFEALNKLKWKSFCIDIAFWKLDIIGMLLITVFFGCVLVPFTLAGGLKEEWKTAHIIVPEVIGWVVVLPLYMLWEIKYSRHPLTPWDLIQDRGIFFALLIAFFINFNWYMQGDYMYTVLVVAVHESIKSATRITSLYSFVSVIVGTILGFILIKVRRTKPFIIFGISCWIVSFGLLVHYRGDSGAHSGIIGSLCLLGFGAGSFTYVTQASIQASAKTHARMAVVTSLYLATYNIGSAFGSSVSGAVWTNILPKEISKRISDPTLAAQAYGSPFTFITTYTWGTPERIALVMSYRYVQKILCIIGLVFCFPLLGCAFMLRNHKLTDSIALEGNDHLESKNTFEIEEKEESFLKNKFFTHFTSSKDRKD

SEQ ID NO: 741 - protein, 606 aa, Saccharomyces cerevisiae
MLETDHSRNDNLDDKSTVCYSEKTDSNVEKSTTSGLRRIDAVNKVLSDYSSFTAFGVTFSSLKTALLVALFLQGYCTGLGGQISQSIQTYAANSFGKHSQVGSINTVKSIVASVVAVPYARISDRFGRIECWIFALVLYTIGEIISAATPTFSGLFAGIVIQQFGYSGFRLLATALTGDLSGLRDRTFAMNIFLIPVIINTWVSGNIVSSVAGNVAPYKWRWGYGIFCIIVPISTLILVLPYVYAQYISWRSGKLPPLKLKEKGQTLRQTLWKFADDINLIGVILFTAFLVLVLLPLTIAGGATSKWREGHIIAMIVVGGCLGFIFLIWELKFAKNPFIPRVYLGDPTIYVALLMEFVWRLGLQIELEYLVTVLMVAFGESTLSAQRIAQLYNFLQSCTNIVVGIMLHFYPHPKVFVVAGSLLGVIGMGLLYKYRVVYDGISGLIGAEIVVGIAGGMIRFPMWTLVHASTTHNEMATVTGLLMSVYQIGDAVGASIAGAIWTQRLAKELIQRLGSSLGMAIYKSPLNYLKKYPIGSEVRVQMIESYSKIQRLLIIVSISFAAFNAVLCFFLRGFTVNKKQSLSAEEREKEKLKIKQQSWLRRVIGY

SEQ ID NO: 742 - protein, 552 aa, Saccharomyces cerevisiae
MGKIAEFLGNPGARPDVHHRAPTVDCKQYEEFGDSNDYKNDDVVRVVSHSDESTDDELCNVNLTETGAIFTSKGFTGLSKGFTDKTLDFLVRVAGSQAVFFIVWIILIIWVVIGIVYNAPFNWQVVMQDGQSIQSYVWDTLLMRQQLMSTHEQILICGRLKSRLASFKNYLTRSTPEEEKADCTVEANEVSSVENHIDPSAINGELPVENWYDRLSNVASRYMGSIAAMVIFWIGIFVWIGCGAIPKDAGNTPPYTGETTGSNPRLKKFSDAWQMYINTAVAVSLLICTTFLQNIRARHDYFTGRFLVDIFDMDEKIDYRIRKHFNDFETPHPVVTIESKKRSTGRKMIDWYADIIGTGIGVLIGVAVFATWIGIGSPMKWDDNWWLIIGTYTGLIGFLDGFVLREVYFRIVQHEEKNYSDVAKEDLELFQELGIECPEEFSGKAPEINTIGYRTSQYINRICSTPWSVLVSVIIIIGLICIASGLRWSTTGQLIANTPTMIIEEFFLLVLLQAHNWADRQRRVEVTALYARRRILLSYVEKRFPEVMMLEK

SEQ ID NO: 743 - protein, 575 aa, Saccharomyces cerevisiae
MVNVGPSHAAVAVDASEARKRNISEEVFELRDKKDSTVVIEGEAPVRTFTSSSSNHEREDTYVSKRQVMRDIFAKYLKFIGPGLMVSVAYIDPGNYSTAVDAGASNQFSLLCIILLSNFIAIFLQCLCIKLGSVTGLDLSRACREYLPRWLNWTLYFFAECAVIATDIAEVIGTAIALNILIKVPLPAGVAITVVDVFLIMFTYKPGASSIRFIRIFECFVAVLVVGVCICFAIELAYIPKSTSVKQVFRGFVPSAQMFDHNGIYTAISILGATVMPHSLFLGSALVQPRLLDYDVKHGNYTVSEEQDKVKKSKSTEEIMEEKYFNYRPTNAAIKYCMKYSMVELSITLFTLALFVNCAILVVAGSTLYNSPEADGADLFTIHELLSRNLAPAAGTIFMLALLLSGQSAGVVCTMSGQIVSEGHINWKLQPWQRRLATRCISIIPCLVISICIGREALSKALNASQVVLSIVLPFLVAPLIFFTCKKSIMKTEITVDHTEEDSHNHQNNNDRSAGSVIEQDGSSGMEIENGKDVKIVYMANNWIITVIAIIVWLFLSLLNVYAIVQLGMSHGDIS

SEQ ID NO: 744 - protein, 322 aa, Saccharomyces cerevisiae
MSIVALKNAVVTLIQKAKGSGGTSELGGSESTPLLRGSNSNSSRHDNLSSSSSDIIYGRNSAQDLENSPMSVGKDNRNGDNGSDNEKANLGFFQSVDPRVISDLIIGLSDGLTVPFALTAGLSSLGDAKLVITGGFAELISGAISMGLGGYLGAKSESDYYHAEVKKEKRKFYDNSNLINREIEDILLEINPNFSDETIVSFIKDLQRTPELMVDFIIRYGRGLDEPAENRELISAVTIGGGYLLGGLVPLVPYFFVSDVGTGLIYSIIVMVVTLFWFGYVKTKLSMGSGSSTSKKVTEGVEMVVVGGVAAGAAWFFVKLLG

SEQ ID NO: 745 - protein, 245 aa, Saccharomyces cerevisiae
MALPLIKPKESEESHLALLSKIHVSKNWKLPPRLPHRAAQRRKRVHRLHEDYETEENDEELQKKKRQNRDAQRAYRERKNNKLQVLEETIESLSKVVKNYETKLNRLQNELQAKESENHALKQKLETLTLKQASVPAQDPILQNLIENFKPMKAIPIKYNTAIKRHQHSTELPSSVKCGFCNDNTTCVCKELETDHRKSDDGVATEQKDMSMPHAECNNKDNPNGLCSNCTNIDKSCIDIRSIIH

SEQ ID NO: 746 - protein, 465 aa, Saccharomyces cerevisiae
MAFEDYFSFQIFFIFLRKSLEIVVIVSILLTIVKQDLSVEDDSPFEGSSSSAGLPSPNTNTNADSTTAFLQAGPSDGNAIGTSATAANNKSRPLNVEEEEEIYEYSNELRDQDRESDEHTADNVKLYQKLKIQILAGGAFGLLLCMLIGGAFVSIFYHIGTDLWTLSEHYYEGVLSLVASVIISVMGLFFLRMGKLREKFRVKLASIIYSKDNNLLGNKTQKGVKFSQKYSFFILPFITTLREGLEAVYSIGGIGIDQPLSSIPLSMVLATAISTVFGIFFFRYSSSLSLKICLVVATCFLYLIAAGLFSKGVWQLELQDYVNKCNGQDMSEVENGPGSYDISRSVWHVNCCNGEKDGGWMIFTAIFGWTNSATVGSVISYNAYWLVLKYALKLLMIEGKCGYIPYLPISWQKKRIMKRLSIAKASLDLKHHTSELNSSTSEPDSQRRSKDSSVPLIIDSSGSAN

SEQ ID NO: 747 - protein, 622 aa, Saccharomyces cerevisiae
MLFYSFVWSVLAASVALAKTHKLNYTASWVTANPDGLHEKRMIGFNGEWPLPDIHVEKGDRVELYLTNGFQDNTATSLHFHGLFQNTSLGNQLQMDGPSMVTQCPIVPGQTYLYNFTVPEQVGTFWYHAHMGAQYGDGMRGAFIIHDPEEPFEYDHERVITLSDHYHENYKTVTKEFLSRYNPTGAEPIPQNILFNNTMNVTLDFTPGETYLFRFLNVGLFVSQYIILEDHEMSIVEVDGVYVKPNFTDSIYLSAGQRMSVLIKAKDKMPTRNYAMMQIMDETMLDVVPPELQLNQTIQMRYGHSLPEARALNIEDCDLDRATNDFYLEPLIERDLLAHYDHQIVMDVRMVNLGDGVKYAFFNNITYVTPKVPTLTTLLTSGKLASDPRIYGDNINAQLLKHNDIIEVVLNNYDSGRHPFHLHGHNFQIVQKSPGFHVDEAYDESEQDEMTVPYNESAPLQPFPERPMVRDTVVLEPSGHVVLRFRADNPGVWYFHCHVDWHLQQGLASVFIEAPVLLQEREKLNENYLDICKAADIPVVGNAAGHSNDWFDLKGLPRQPEPLPKGFTTEGYLALIISTIIGVWGLYSIAQYGIGEVIPNDEKVYHTLREILAENEIEVSRG

SEQ ID NO: 748 - protein, 473 aa, Saccharomyces cerevisiae
MRSYMQILQKFAKFIGPGILVSVAYMDPGNYATSVSGGAQYKYTLLFSIFISNIFAVLLQCLCVKLGTITGYDLAENCRHNLPKKLNYTLYLFAEVAIIATDLAEVVGTAIALQILFKIPLTWGVLLTVLDVLVILMFYTPNGQSLKKVRVFEFGVGILVIGTCICFVLELFKVSIPDKAELFKGFLPSNIIFKEQQALYISLGILGATVMPHSLYLGSSIVKPRLHDYDLKKYGKVNARPSLSAIKYTLNYAYAELIISLFLIATFVNSAILIVAGATLSGQPEAEDADLLSIYKLLVHYISPAAGLIFALAMLCSGQSAGIICTLAGQIVSEGFLQWSLPPWATRLCTRLIAIVPCLFVTLTMGEKGISDILNFSQVVLSLILPIVSAPLIYFTANRKLMVVHDENGVVRAPADVNAIADETTPLNSKHSKIVDFTNSRLLTYTSVFVWALIGSLNCYLVISYLLGADIHF

SEQ ID NO: 749 - protein, 439 aa, Saccharomyces cerevisiae
MKLGSKQVKIISLLLLDTVFFGIEITTGYLSHSLALIADSFHMLNDIISLVVALWAVNVAKNRNPDSTYTYGWKRAEILGALINAVFLIALCVSILIEALQRIIAPPVIENPKFVLYVGVAGLISNTVGLFLFHDNDQEHGHGHGHSHGGIFADHEMHMPSSHTHTHAHVDGIENTTPMDSTDNISEIMPNAIVDSFMNENTRLLTPENASKTPSYSTSSHTIASGGNYTEHNKRKRSLNMHGVFLHVLGDALGNIGVMLSAFFIWKTDYSWKYYTDPLVSLIITGIIFSSALPLSCKASKILLQATPSTLSGDQVEGDLLKIPGIIAIHDFHIWNLTESIFIASLHIQLDISPEQFTDLAKIVRSKLHRYGIHSATLQPEFITREVTSTERAGDSQGDHLQNDPLSLRPKTYGTGISGSTCLIDDAANCNTADCLEDH

SEQ ID NO: 750 - protein, 712 aa, Saccharomyces cerevisiae
MHRTLLFLTWLISLTKAFNIKLPHTEKKDHLESNAVLACASYINTLKWSFDSSVVPGFYSTICSYSPAFDTWSLCIFNSLTDQIIPMDNTSFEESLGNVRKTCSFVDKKFSNISLEQYYSSLNNASSHALEDYGSIESLSTSIRVDRETRSRWIRAFHAHAYNLDISSVYGAYLTYYFVIVGIIAVFFHMSHYNGLNRALFASRFVNYIRGHFVLPTFLVDKHANHFKFLNVEVFTGLMPNSLEAWIIFGYTLANIIFLSISYIIDPYNLIFNSHLSQFTRLLADRSGILAFTQFPLIIIFTARNSFLEFLTGVKFNSFISFHKWIGRIMVLNATIHSLSYSLFAIINHAFKISNKQLYWKFGIASITVLCVLLVLSLGIVRKRHYEFFLYTHIILALLFFYCCWQHVKIFNGWKEWIVVSLLIWGLEKLFRIWNILQFRFPKATLINLNTSNNPHDEMFKVIIPKYNRRWHSKPGQYCFIYFLHPLVFWQCHPFTIIDEGEKCVLVIKPKSGLTRFIYNHILQSLNGKLQLRVAIEGPYGPSNLHLDKFDHLLLLSGGTGLPGPLDHAIKLSRNPDKPKSIDLIMAIKNPSFLNGYKSEILELKNSRSHVNVQVYLTQKTAVTKAANARDQLIHFDDIMTELTSFAHIGNARPNFSNVIENAIKSTPPGDSLAVVCCGPPVLVDDVRNTVSQKLLGYPERIIEYFEEYQCW

SEQ ID NO: 751 - protein, 304 aa, Saccharomyces cerevisiae
MNTSELSIAEEIDYEALPSHAPLHSQLLAGAFAGIMEHSLMFPIDALKTRVQAAGLNKAASTGMISQISKISTMEGSMALWKGVQSVILGAGPAHAVYFGTYEFCKARLISPEDMQTHQPMKTALSGTIATIAADALMNPFDTVKQRLQLDTNLRVWNVTKQIYQNEGFAAFYYSYPTTLAMNIPFAAFNFMIYESASKFFNPQNSYNPLIHCLCGGISGATCAALTTPLDCIKTVLQVRGSETVSIEIMKDANTFGRASRAILEVHGWKGFWRGLKPRIVANIPATAISWTAYECAKHFLMKN

SEQ ID NO: 752 - protein, 314 aa, Saccharomyces cerevisiae
MVENSSSNNSTRPIPAIPMDLPDYEALPTHAPLYHQLIAGAFAGIMEHSVMFPIDALKTRIQSANAKSLSAKNMLSQISHISTSEGTLALWKGVQSVILGAGPAHAVYFGTYEFCKKNLIDSSDTQTHHPFKTAISGACATTASDALMNPFDTIKQRIQLNTSASVWQTTKQIYQSEGLAAFYYSYPTTLVMNIPFAAFNFVIYESSTKFLNPSNEYNPLIHCLCGSISGSTCAAITTPLDCIKTVLQIRGSQTVSLEIMRKADTFSKAASAIYQVYGWKGFWRGWKPRIVANMPATAISWTAYECAKHFLMTY

SEQ ID NO: 753 - protein, 152 aa, Saccharomyces cerevisiae
MSFIKNLLFGGVKTSEDPTGLTGNGASNTNDSNKGSEPVVAGNFFPRTLSKFNGHDDEKIFIAIRGKVYDCTRGRQFYGPSGPYTNFAGHDASRGLALNSFDLDVIKDWDQPIDPLDDLTKEQIDALDEWQEHFENKYPCIGTLIPEPGVNV

SEQ ID NO: 754 - protein, 560 aa, Saccharomyces cerevisiae
MNWSFLLQLVITILLIVLGANWLLSSFLLDFKRDLTGVALSQQSSISSVRKENETAYYRSILVPTGFPLTTGLGLSLKYKIRNGNFGDVWNAIMEVSKGKNIIKFTGREKSYSLSELNGMAKRIFPKLSNKNFKNIGIANSIATVEGFTLSLASMMTSIRTGSIPHFLPAVPRQRLEDVDVLIIDSWKSFKMLNGSEDWYKLIVVCDDPIESLQFDANCDVITWKELIDGFTKDTEYQYTPPDDNSDDKKLFAYVTSPWNGTNSFNQICLVSNIAEFIKGFPLGNELNSNEYLTISTKLANSSASLQIWGKLFAVLLHGGSASFINPTTIDCESLQETTLLFTETKDVVKLIDSNSRSGLLNKIYLSWATNLLSEGIFTKIARIEPHSLEKLRCVYLADNVKDAEVISTFPEKIPQLKKTNRRITPSTEQLNKIRAQLGSRVVLELYCPYAIMGPVAHTNFYDYRVFGKSVDDNVVCYGTLSTTLEGKMVETETNPHLNIEKKQGMLCIRGFSIGKPVESDRLEKALHLAERFGGGEGWMPLVGVFGLFGQDGCLYIYNQ

SEQ ID NO: 755 - protein, 593 aa, Saccharomyces cerevisiae
MTISNKSWRSYFPHLRKLPEDDQYLYSDDTNSSIIAEEELHHSVDKSSKTDVTAETTAVEPHPHNLRHDLPYEVRDEAGRKWWKYFDEFEYRVNKEYKKSRKWYEFLYPNHTTQTKAERRLLYKLDIIIALYFFMLCWSKSVDLNNYTNAYVSNMKEDLNMKGNDYVYTSTIANVGAIVFQLPFMYLLPRFPSHIILPVMDLGWTWFTFACYRANSLAELRAYRFILSAFGAAYYPVSQYILGCWYAPDEINSRVCLFFCGQQLGSVTSGLLQSRIFKSLNGVHGLAGWRWMFLIDAIAISLPTAIIGFFVIPGVPSKCYSLFLTDEEIRIARARNKRNQIKDGVDKSKLAPLWSRKLWKKVFCTPAFWVLVVFDTCSWNNMTAYSGSYTLWLKSNTKYSIAQVNNLSVIPACLGFAYVIFCAFGADLFRCKWIFMVFAAIMNTVSCALLIKWDIPSKAKWYAFFTTYFSVAASPCLWSFINDFLRFDPQVKAITWIAIYSFSQSTYAWIPTLAWPTVESPRFKTGYTVSLIFGAIYGLWTFVVLFFYKRNEKKHALGNGIILYDSNKGEELPEFVKKNMEERDGYYYLKRSS

SEQ ID NO: 756 - protein, 317 aa, Saccharomyces cerevisiae
MEDSSNTIIPSPTDVGALANRINFQTRDAHNKINTFMGIKMAIAMRHGFIYRQGILAYYYVFDAIEQEIDRLLNDPVTEEELQTSTILKQFWLEDFRRSTQIYKDLKLLYSNTFKSTESLNEFLATFQKPPLLQQFINNIHENIHKEPCTILSYCHVLYLALFAGGKLIRSNLYRRLGLFPNFEKLSQKELVKKGTNFFTFSDLGPTEETRLKWEYKKNYELATRTELTEAQKLQIISVAEGIFDWNFNIVAEIGELNRRELMGKFSFKCITYLYEEWMFNKDSATRRALHTVMLLVLSIIAIWVLYFLVKSFLSIV

SEQ ID NO: 757 - protein, 285 aa, Saccharomyces cerevisiae
MWAQLSYTRPESQKTDLTSLFSTDQEQNPLNDYQYQINIRELEEYYNKTILNEDNIQETSSEISSAVSFSPPKNTNAIQPGLLYDPQLMNPFLPSAHLNSTAPTTFKKKLEVQINPDYVPKSSQLPLTSQNLQQLSQQKPKNDASFSSEKESSAQPKVKSQVQETPKQLYKTELCESFTLKGSCPYGSKCQFAHGLGELKVKKSCKNFRTKPCVNWEKLGYCPYGRRCCFKHGDDNDIAVYVKAGTYCNVSSTSKQSDEKRSNGRGSAKKKNLNVKVKALQRMTW

SEQ ID NO: 758 - protein, 325 aa, Saccharomyces cerevisiae
MMPNVAPNSYYLNIPNANSTSTTTSSIFSDLNKEYESKIKEIEEYYIKTLLNENTDNDDSSSSEGHNINETDILSEYSPRPSPWLPSKPNCYHPLGDFKDLIISDSRPTNTLPINNPFAGNNNISTLATTEKKRKKRSLEVEINPTYTTSAFSLPLTAENLQKLSQVDSQSTGLPYTLPIQKTTKLEPCRRAPLQLPQLVNKTLYKTELCESFTIKGYCKYGNKCQFAHGLNELKFKKKSNNYRTKPCINWSKLGYCPYGKRCCFKHGDDKDVEIYQNANDGRSKDTALTPLPTSLAPSNNDNITNLSKPRNLHTSVKALQRMTW

SEQ ID NO: 759 - protein, 174 aa, Saccharomyces cerevisiae
MIKRSLASLVRVSSVMGRRYMIAAAGGERARFCPAVTNKKNHTVNTFQKRFVESSTDGQVVPQEVLNLPLEKYHEEADDYLDHLLDSLEELSEAHPDCIPDVELSHGVMTLEIPAFGTYVINKQPPNKQIWLASPLSGPNRFDLLNGEWVSLRNGTKLTDILTEEVEKAISKSQ

SEQ ID NO: 760 - protein, 657 aa, Saccharomyces cerevisiae
MLKSGRLNFLKLNINSRLLYSTNPQLTKKVIGIDLGTTNSAVAYIRDSNDKKSATIIENDEGQRTTPSIVAFDVKSSPQNKDQMKTLVGMAAKRQNAINSENTFFATKRLIGRAFNDKEVQRDMAVMPYKIVKCESNGQAYLSTSNGLIQSPSQIASILLKYLKQTSEEYLGEKVNLAVITVPAYFNDSQRQATKDAGKLAGLNVLRVINEPTAAALSFGIDDKRNNGLIAVYDLGGGTFDISILDIEDGVFEVRATNGDTHLGGEDFDNVIVNYIIDTFIHENPEITREEITKNRETMQRLKDVSERAKIDLSHVKKTFIELPFVYKSKHLRVPMTEEELDNMTLSLINRTIPPVKQALKDADIEPEDIDEVILVGGMTRMPKIRSVVKDLFGKSPNSSVNPDETVALGAAIQGGILSGEIKNVLLLDVTPLTLGIETFGGAFSPLIPRNTTVPVKKTEIFSTGVDGQAGVDIKVFQGERGLVRNNKLIGDLKLTGITPLPKGIPQIYVTFDIDADGIINVSAAEKSSGKQQSITVIPNSGLSEEEIAKLIEEANANRAQDNLIRQRLELISKADIMISDTENLFKRYEKLISSEKEYSNIVEDIKALRQAIKNFKANENDMSIDVNGIKKATDALQGRALKLFQSATKNQQNQGK

SEQ ID NO: 761 - protein, 165 aa, Saccharomyces cerevisiae [sequence omitted]

SEQ ID NO: 762 - protein, 156 aa, Saccharomyces cerevisiae
MFARLANPAHFKPLTGSHITRAAKRLYHPKVIDHYTNPRNVGSMDKSLANVGTGIVGAPACGDVIKLQIQVNDKSGIIENVKFKTFGCGSAIASSSYMTELVRGMSLDEAVKIKNTEIAKELSLPPVKLHCSMLAEDAIKAAIKDYKTKRNPSVLH

SEQ ID NO: 763 - protein, 690 aa, Saccharomyces cerevisiae
MLLLPRCPVIGRIVRSKFRSGLIRNHSPVIFTVSKLSTQRPLLFNSAVNLWNQAQKDITHKKSVEQFSSAPKVKTQVKKTSKAPTLSELKILKDLFRYIWPKGNNKVRIRVLIALGLLISAKILNVQVPFFFKQTIDSMNIAWDDPTVALPAAIGLTILCYGVARFGSVLFGELRNAVFAKVAQNAIRTVSLQTFQHLMKLDLGWHLSRQTGGLTRAMDRGTKGISQVLTAMVFHIIPISFEISVVCGILTYQFGASFAAITFSTMLLYSIFTIKTTAWRTHFRRDANKADNKAASVALDSLINFEAVKYFNNEKYLADKYNGSLMNYRDSQIKVSQSLAFLNSGQNLIFTTALTAMMYMGCTGVIGGNLTVGDLVLINQLVFQLSVPLNFLGSVYRDLKQSLIDMETLFKLRKNEVKIKNAERPLMLPENVPYDITFENVTFGYHPDRKILKNASFTIPAGWKTAIVGSSGSGKSTILKLVFRFYDPESGRILINGRDIKEYDIDALRKVIGVVPQDTPLFNDTIWENVKFGRIDATDEEVITVVEKAQLAPLIKKLPQGFDTIVGERGLMISGGEKQRLAIARVLLKNARIMFFDEATSALDTHTEQALLRTIRDNFTSGSRTSVYIAHRLRTIADADKIIVLDNGRVREEGKHLELLAMPGSLYRELWTIQEDLDHLENELKDQQEL

SEQ ID NO: 764 - protein, 150 aa, Saccharomyces cerevisiae
MFLPKFNPIRSFSPILRAKTLLRYQNRMYLSTEIRKAIEDAIESAPVVLFMKGTPEFPKCGFSRATIGLLGNQGVDPAKFAAYNVLEDPELREGIKEFSEWPTIPQLYVNKEFIGGCDVITSMARSGELADLLEEAQALVPEEEEETKDR

SEQ ID NO: 765 - protein, 143 aa, Saccharomyces cerevisiae
METNFSFDSNLIVIIIITLFATRIIAKRFLSTPKMVSQETVAHVKDLIGQKEVFVAAKTYCPYCKATLSTLFQELNVPKSKALVLELDEMSNGSEIQDALEEISGQKTVPNVYINGKHIGGNSDLETLKKNGKLAEILKPVFQ

SEQ ID NO: 766 - protein, 491 aa, Saccharomyces cerevisiae
MSALLSESDLNDFISPALACVKPTQVSGGKKDNVNMNGEYEVSTEPDQLEKVSITLSDCLACSGCITSSEEILLSSQSHSVFLKNWGKLSQQQDKFLVVSVSPQCRLSLAQYYGLTLEAADLCLMNFFQKHFQCKYMVGTEMGRIISISKTVEKIIAHKKQKENTGADRKPLLSAVCPGFLIYTEKTKPQLVPMLLNVKSPQQITGSLIRATFESLAIARESFYHLSLMPCFDKKLEASRPESLDDGIDCVITPREIVTMLQELNLDFKSFLTEDTSLYGRLSPPGWDPRVHWASNLGGTCGGYAYQYVTAVQRLHPGSQMIVLEGRNSDIVEYRLLHDDRIIAAASELSGFRNIQNLVRKLTSGSGSERKRNITALRKRRTGPKANSREMAAATAATADPYHSDYIEVNACPGACMNGGGLLNGEQNSLKRKQLVQTLNKRHGEELAMVDPLTLGPKLEEAAARPLSLEYVFAPVKQAVEKDLVSVGSTW

SEQ ID NO: 767 - protein, 293 aa, Saccharomyces cerevisiae
MEEQEIGVPAASLAGIKHIILILSGKGGVGKSSVTTQTALTLCSMGFKVGVLDIDLTGPSLPRMFGLENESIYQGPEGWQPVKVETNSTGSLSVISLGFLLGDRGNSVIWRGPKKTSMIKQFISDVAWGELDYLLIDTPPGTSDEHISIAEELRYSKPDGGIVVTTPQSVATADVKKEINFCKKVDLKILGIIENMSGFVCPHCAECTNIFSSGGGKRLSEQFSVPYLGNVPIDPKFVEMIENQVSSKKTLVEMYRESSLCPIFEEIMKKLRKQDTTTPVVDKHEQPQIESPK

SEQ ID NO: 768 - protein, 328 aa, Saccharomyces cerevisiae
MTEILPHVNDEVLPAEYELNQPEPEHCPGPESDMAGKSDACGGCANKEICESLPKGPDPDIPLITDNLSGIEHKILVLSGKGGVGKSTFAAMLSWALSADEDLQVGAMDLDICGPSLPHMLGCIKETVHESNSGWTPVYVTDNLATMSIQYMLPEDDSAIIWRGSKKNLLIKKFLKDVDWDKLDYLVIDTPPGTSDEHISINKYMRESGIDGALVVTTPQEVALLDVRKEIDFCKKAGINILGLVENMSGFVCPNCKGESQIFKATTGGGEALCKELGIKFLGSVPLDPRIGKSCDMGESFLDNYPDSPASSAVLNVVEALRDAVGDV

SEQ ID NO: 769 - protein, 330 aa, Saccharomyces cerevisiae
MASINLIKSLKLYKEKIWSFDFSQGILATGSTDRKIKLVSVKYDDFTLIDVLDETAHKKAIRSVAWRPHTSLLAAGSFDSTVSIWAKEESADRTFEMDLLAIIEGHENEVKGVAWSNDGYYLATCSRDKSVWIWETDESGEEYECISVLQEHSQDVKHVIWHPSEALLASSSYDDTVRIWKDYDDDWECVAVLNGHEGTVWSSDFDKTEGVFRLCSGSDDSTVRVWKYMGDDEDDQQEWVCEAILPDVHKRQVYNVAWGFNGLIASVGADGVLAVYEEVDGEWKVFAKRALCHGVYEINVVKWLELNGKTILATGGDDGIVNFWSLEKAA

SEQ ID NO: 770 - DNA, 2073 bp, Saccharomyces cerevisiae
atggaaggcttcaatccggctgacatagaacatgcgtcaccgattaattcatctgacagccattcatcctcctttgtatatgctctacccaaaagtgctagtgaatatgtagtcaaccataatgagggtcgtgcaagtgcaagtggaaatccagccgcagtgccgtctcccataatgacactgaatctcaaaagcacacattccctcaatattgatcagcatgttcatacctcaacatcgccgacggaaactattgggcatattcatcatgtggaaaagctgaatcaaaacaatttgattcatctggatccagtacccaactttgaagataagtccgatattaagccttggttgcaaaagattttttatcctcaaggaatagaacttgtgatagaaaggtcggacgcatttaaagttgtcttcaagtgtaaagctgctaaaaggggaaggaacgcgagaaggaaaagaaaagataagcccaaaggacaggaccacgaagacgagaaatccaagatcaatgatgacgaattagaatatgcgagtccttctaatgccacagtaaccaatgggcctcaaacatcgcccgatcaaacatcctccataaagccaaagaaaaaaagatgtgtatcgaggtttaataactgtccgtttagagtacgagctacttattcgttaaagaggaaaagatggagcattgttgtaatggacaataaccattcacatcagctaaagtttaaccctgattccgaagagtacaaaaaattcaaagaaaaattaagaaaggataatgacgtagatgcaatcaagaaattcgacgaattggaatacagaactttggccaatttgcccattccaacagctacaatcccctgtgattgtggtttaacaaatgaaatacaaagtttcaatgtcgtattgcccactaacagtaatgttacttcatcagcatcctcttcaactgtatcgtccatatcccttgattcatcgaatgcatctaaaaggccatgcttaccctctgtaaataacaccggtagtatcaataccaataacgtaaggaaaccgaaaagccagtgtaagaataaagacacactcttaaaaagaaccaccatgcagaactttctcacaactaaatcaaggctgcgtaagaccggtacgccaacatcttcgcaacactcatctacagcattttcaggatatattgatgatcctttcaatttgaatgaaatcttgccactgccggcatccgatttcaagctaaacactgtaacaaatttgaacgaaattgactttacgaacatttttaccaaatcgccgcatccacatagcgggtctacccatccaagacaagtcttcgaccaattggacgattgttcctctatactcttctctccattaactacaaacacgaataatgaatttgaaggagagtcagatgattttgttcattctccatatttgaactcagaggcagatttcagccaaattcttagtagtgctcccccagtccatcatgacccaaatgaaacacatcaggaaaaccaggatattattgatagatttgctaatagttcccaagaacataatgagtatattctacaatatttgacgcactccgatgctgctaaccacaataacatcggcgttccaaacaacaattcacattcgctaaatactcagcataacgtttctgatctgggcaactcacttttaagacaagaagctttagttggcagctcttcaacaaaaatcttcgacgaattgaaatttgtacaaaatggcccacacggttctcaacatcctatagattttcaacatgttgaccatcgtcatctcagctctaatgaacctcaagtacgatcacatcaatatggtccgcaacagcagccaccgcagcaattgcaatatcaccaaaatcagccccacgacggccataaccacgaacagcaccaaacagtacaaaaggatatgcaaacgcatgaatcgctagaaataatgggaaacacattattggaagagttcaaagacattaaaatggtgaacggcgagttgaagtatgtgaagccagaagattag

SEQ ID NO: 771 - DNA, 1251 bp, Saccharomyces cerevisiae
atgaaagcaaagtcgatgaagagcataatatctgtgccaatatcagtgtctaaaacagggaaaatgaagttaacagcatctcccgataatctagcatctatgatgtctaaagaccaaaataaacttattcatttagacccagttccgtcttttgaggacaggcacgagattaaaccgtggctacagaaaatattctatcctcaaggaatagatatagtcatcgaaagatcagatagtagcaaagttacttttaagtgtaggtcagtacgatcgaaagtagggttgaaccctaaatccaaaggttcctcttcaagatcccatgcatgtccatttagaattagagcagcctactctgtgcggttacagaagtggaacgtggttgttatgaataacatacattcacatgagctgagatttgatttgattactaaaacggatgactataaaaagtttaaggaaaatcttcgtcagaagaacgacgaaaaagccatcaaaacatttgatgaattagaatataaagcaagtctaaacttaccactcgtcacaccaattatttcttgtgactgtgggttaaccaaggaaattgaagctttcaataacatttttctcccactatcaaacccccctttgacgtctaaaaaaaatttgctcaaaacaaataaaaactccgtttctaaaataaaatccagacagatggataattcgaaacctaggccaaggttgaaaacgaagttggatgcggatctacatgataccggatttttagacaatttcaaaacgcggaattcctgtgtaaagatagagaaagaagattctttaacgaacttaaacgaaattgattttacgaacatgttttgcaacgacaatttcatccaaaattacaaccaaggcctgatggaacttttgacagaacctacaccaggtccttcgtcctcttcttgtatacttccttcaacaccaacgaggcccttgtcacaaagcaaaatggatatagccctgtcagaatcaacaacatcttcaccaaattttatggaaacagacgctccttatggagatgagatcattaaagtttccaaagataccaaaagcaacgcaccaactgctgatacagatattgctacgaacttaggcaaagagagaaacgaaaattttggcatgttaaactacaactacgaagcgttgcttcatttcaacgatgagcattttaatgaattaaattctattgacccagccttaatatcaaaatattaa

SEQ ID NO: 772 - DNA, 2250 bp, Saccharomyces cerevisiae
atgacttcgaaaccatccaccagtgacggcagggctcactcgatttcccatgtacctggcacgcacatgagaggaacatcggcatcacacagccccagaccgtttaggccatgtgcggattgtacgtgttctccaggcttactgtctaggcaaggtcgtagagcctctctatttttaagacagttagaaaattcaaggaggtcctccagcatgcttctcaacgagttgaagggcgctggcggaggtagcagtgctggaaatgggtctgtttactcatgtgactctctatgcgctgttaacagggaagttaacactactgatagattgttgaagttgcgtcaggagatgaagaaacacgatttgtgttgttatattgtgcccagttgtgacgaacatcagtccgaatatgtatcattgcgagatcaaaggcgcgccttcatttcagggttttccggatcggccggtgtagcctgtatcaccagagacttgttaaatttcaacgatgaccatccggatgggaaatccattttgagtactgatggaagatatttcaatcaagctagacaagaactagattataattggacacttttgaggcaaaacgaagacccaatcacttggcaagaatggtgtgtcagagaagctttggaaatggccaagggacttggcaataaagagggaatggtgttgaagataggtattgacccaaaacttatcactttcaacgactatgtttcttttagaaaaatgattgacactaaatatgacgcaaagggtaaagtggagctggttcccgtggaggaaaacttagttgacagtatttggcctgattttgaaactctacctgaaaggccttgtaacgatttactactgttaaaatacgagtttcatggtgaagaattcaaagacaagaaggaaaagttactgaaaaagctgaatgataaggcttcctctgcgacgaccggtaggaatactttcatagtagttgcgttggatgaaatttgttggttgttgaacttgcgtggatccgacattgactataatccagtttttttctcctacgtggctattaacgaagacgaaaccattcttttcaccaataaccccttcaatgatgacatatcggaatattttaagataaacggtattgaagtcagaccttacgaacagatatgggaacatttaacaaagataacttcgcaggcttcttctgcggagcatgaatttttgattcctgatagtgcatcgtggcagatggttcgttgtttgaacacctcaaccaacgctaacggtgcaatagctaaaaaaatgactgcacaaaactttgcgataattcactcacccatcgatgttttgaaatctatcaagaatgacatcgaaataaaaaacgcacacaaggcgcaggtcaaagacgcagtatgtttagtgcagtattttgcatggctggagcagcaattagtggggcgcgaggcactgatagatgaatatcgtgccgcagaaaaattgaccgagattaggaaaacccaaaggaacttcatgggcaattccttcgaaacaatatcctccacaggtagtaacgccgccatcatacattattcgccgcccgtagagaactcttcgatgattgatcctaccaagatatatctttgcgactccggttcgcaattcttggagggtacaactgatataacaagaacaattcacttaacaaagccaaccaaagaagaaatggataattacacactggtacttaaaggtggcttagccctagagaggttgatttttcccgaaaacactcccgggtttaatatcgacgccatcgctaggcagtttttatggtcccgcgggttagattacaaacatggcacaggccatggtatcggatcatttttaaacgttcacgaaggacccatgggtgtcggctttaggccacatctgatgaatttccccttaagagcgggtaacataataagtaacgaaccaggttattataaggatggtgagtatggtatcaggattgaaagcgacatgttaatcaagaaggccactgagaagggtaacttcttgaaattcgaaaacatgactgtggttccctattgcaggaagttgatcaatactaagttactaaacgaagaagaaaaaacacagattaacgagtaccacgcaagggtatggaggacaatagtgcattttctgcagcctcagagtatttcatacaagtggctgaaaagagaaacaagcccactatga

SEQ ID NO: 773 - DNA, 363 bp, Saccharomyces cerevisiae
atgacaggtgaaagaattgaaaaggtgaaaataaatgacgaatttgcaaaatcacatttcctaacaactcagtggagagaaacaaagcgccaacgacactataagatgcccgttactgaacagggactccgcgagaggatagaatcagccataccgcaagtttaccatatcattgtgacggatctttcgtacggttgtggtcagtcgtttgatattgtggtggtcagcgacttctttcaaggtaaaagcaaactaatgaggagtcgtgcagtgaacaaggctgtgaaagaagagctgcaggagattcatgcctttagctgcaagtgctacactgaggaggaatggtctaagattgtggtatga

SEQ ID NO: 774 - DNA, 858 bp, Saccharomyces cerevisiae
atgtgttcttttcaggttccatctgcattttcttttaactacacctcgtactgttataaacgccaccaagcaagatattacacagcagcaaaactttttcaggaaatgcctgttattgaaattaacgatcaagagcaatttacttacctaactaccactgcggccggcgacaagttaatcgtgctttatttccataccagttgggcagaaccatgcaaagcattaaagcaggtttttgaggccattagtaatgagccttccaattccaacgtctctttcttatccattgatgcggacgaaaactcggaaatttcagaactttttgaaatctcagctgttccatattttatcataattcacaaagggacaatcttaaaagaattatccggcgcggatccaaaggagtatgtgtctttattagaagactgcaagaactcagtcaattccggatcatcacaaactcatactatggaaaatgcaaacgtaaatgaggggagtcataatgatgaagacgatgacgacgaagaagaggaagaagaaactgaggagcaaataaacgctagattgactaaattggtcaatgccgcgccggtaatgttatttatgaaggggagcccctctgaacctaaatgcgggttttcgagacaacttgtgggtatcttgagagaacatcaagtaagatttggcttctttgatatattaagagacgaatctgttagacaaaacttgaaaaagttttctgaatggccaactttccctcaactttatataaatggggagtttcaaggcggtttagacattatcaaggaatccttggaggaagaccctgattttttgcagcatgctctccaatcttaa

SEQ ID NO: 775 - DNA, 735 bp, Saccharomyces cerevisiae
atgactgtggttgaaataaaaagccaggaccaatttacgcaactaaccactacaaacgctgctaataaactcattgtcttatattttaaagctcaatgggctgatccttgcaaaactatgagccaggtgctagaagctgttagtgaaaaagttaggcaagaggatgtccggtttttatcaatagatgcagacgaacatccagaaatatcagacctttttgagattgcagccgtaccatacttcgtcttcattcaaaatggtactattgtaaaagaaatatcagccgcagatcctaaggagtttgtgaaaagcttagaaattctttcgaatgcttctgcctcactagcgaacaatgccaagggtcctaaatctacgtctgatgaggaaagcagcgggtcttccgatgatgaagaggacgaaactgaagaagaaataaatgctaggctggtgaagctagtacaagctgcacctgtgatgctattcatgaaaggaagcccatcagaacctaaatgcggattttctagacagttagttggtatcctcagagaacaccaaataaggttcggattttttgatatattaagagacgaaaacgttagacaaagcttgaagaagttttctgattggcctacttttcctcagttatatatcaatggggagttccagggaggtttggatattatcaaggaatctatagaagaagatcctgaatatttccaacatgctctacagtaa

SEQ ID NO: 776 - DNA, 3675 bp, Saccharomyces cerevisiae
atggattccacaggcgcttctcagattgttagcgcactagatgttatttactcccccaagtctaacaattctcaacggcaagaagctcagaaatttttagatgaagtgaaattatgctcagaatcgcccttttggggctacgaaattgcattgcaaaaccccactaattctatattgaaatactttggactaggattactagaccatgcagtgaagaaaaactggaatgattatgacgaggggaaaagagtggccctgagaaaatgggtcatggaacttaattttggggtgcaagattatgataccagatatattaaggaaaaattagccactttatgggtagaggtggcaaaaagaacatggggtgaggctcttaagcagacaaaccctacggaagaacagttactcacatcttgggtggacatggacaataaccttttcgaactttggaacataaatcaatcgtcaagagaactagcattaataattttcagaatcctttttgaagatgttttcttgttggacgacctaattgttttgaaaaggatgacggttattcaacccttatgtgtaatgattgtttgccctattgaagttttcgcaataaaatacaaattcagtgataaatggaccaaatttaaagctaatgaagagggctggttttctgtttggattccagagttgaataatgcattacaacagaataattctgaatacatcataaggcttttagaaactctgaagacgtgtttaaactggccattaacagaggtcattgtaagaaatgacgtgttatcctccttattgacttgtttatccagcaatatcccaagggcgcagtcaatggcattagactcgatacatattctgttgacccgtccctatagtaatgaaagccattaccaaatgaccatagatcgagtttttgataatatggacttattagatagcgtttatgaaagcttgttgtttgatcctacagatgatatagatgaaacgaaatatcctataattaaaaagttcgtggatatgatcagttgtctctatgtttgtgtcccaaagattaaggagacaaatggccaaattcaaaaatattttaagcttgtattaaagacaacttataacccaagcttaatcgttagcggattaacattagacctatggtgtacctgtcttcgaaacgatgaatacttacccaagctggagaaatatgtcattcctgatctactacagtttgccgcggatgctttagtctattatgaacagattgatggtcatatttccaaaaaatttgcggagattgattttcaatccaagtccgaatttcaaacattttgttccacttataggaaaagaataagagacatcattaggttgatttcttgcgtcgaattagaccttacttatgattggttgaacaacagattaaacaattatttcagctctccatttggtcagcaggtcttaagttccacatttttggaccataaattagagccttatttaggtgccctctcccaatacatgattgttgaatgtttcatcaatggttgtataagatggaagatctggtatccaacaggagatgattatgacgaaaaactagattccatattacaaaaactggaaattttgtcaaaccagttaattgcattaaatttaagagaaccattgttattgaagaaacaaatccaaaattttgcactttttttgacaatgttaaaagataatgtgcttttcacacttttagaaaaaatcataacaagcgccacgatggactatccagaaattaatttggaagagagaggcgctgaatcagacgcagttagagatttgagatatgcttgtggtatcgagttgaataggatggctttattaatgcccgaatctctgaaaaaaatatacccagaccttgaaagtgtcattgccagaatcatgcccaacttatcttaccatgaaaaaatttccttcaaatccttcttattgatcattgtattgaagtcttcattagatatgaaagaggaaagatttgcggctattgtggatccagaacttttagcctggtctgataaaacaacagttgttggtctttctgatttgcattggtttatggaacgcttaggtattgttcagatcgcagaatatttccagaggcgtgatatcgacgaaaatagtgaccttttatcaattccaattgatgatgagggtaaagagctgaagtcggaattgaccaaacgttggcaaagcttgtttcctgttcgtgcaacaagaatgttcattcattattcaatgcaaagtataaagacagatgaagaattcaaaatgctacaagatctgtggagacctaggattgtcccaatattaccttacatcacgagactactgtaccaattgcaatcctaccacgatccagataattggaaaggattacctacggttgtgcaatccttcgtcaagtattccactattgaaagattttgggaggccggagcttcaaataaatcaaaggatgagtttattgatgaacatatgaaagcgatgcaaaccttacgagacttcgccgactccgtaggacacatcattaggtatacaagggaatacactctacttgttttaagtgccatatcatcacttggtagtgttttttaccttttggacgaatcgcccgacctactactgaactctattgccatatttaagccaggtagcaatgagataagccctggagtttcaacacatggatggaaacacataatgaatatagccattcgtcctatattaaaaggttgtccaaaagattgtctggggaaattcatgcccgcatttttgcctaaattatttgaaatcctggacctgctgctatgtcagaaatggtcctcgcatatgaatgatatggacatgaacccagttccaactgacgatgatcaaatgactgaagaaattttggaagagaatttgttgagacaactaaccacagttgttgttagaatagtaattgattgtgttggtcaaggcaatgccaatccaaacagtgctaaaagcaggctaaataaccatcaaatggagatgagaaaaattatatttaatgatttaaacacccttgctccatttttgaaacttttgaaccatttaatttccttcaaggatacaaaatgttcatttaactccatcctagtaatgaaatgctgcttaacctcagtccttaatcaaaacaacacggtggatgaatatttcacatttgaagtgatgaaaaatctgttgctaaatgtgctgtgtaatagtgcgtttaaggattctttccatgaggcactatatgctttcactgtgatttttttgactctgtgcaaagaatatccctctgctagagcgttcctttttgagatatctaatggttataatattgatgagttatacagaaatttaaggagcgtggacgaatacaaaacacaaagggcactcatgattgattttatagattgggttaaatccaccagtgggaaagaagatggtaatgtggaccatgcaggcgatgagagaaaaagacaagagaaaagggaagctatcctcaagaaggcaaatgagagattaattaagaagaataaagaaaacggagacatgctggatgatccgaacattgaagacggtgctgtgggtaatctctttgatgacaactga

SEQ ID NO: 777 - DNA, 3270 bp, Saccharomyces cerevisiae
atgtctgctttaccggaagaagttaatagaacattacttcagattgtccaggcgtttgcttcccctgacaatcaaatacgttctgtagctgagaaggctcttagtgaagaatggattaccgaaaacaatattgagtatcttttaacttttttggctgaacaagccgctttctcccaagatacaacagttgcagcattatctgctgttctgtttagaaaattagcattaaaagctcccccttcttcgaagcttatgattatgtccaaaaatatcacacatattaggaaagaagttcttgcacaaattcgttcttcattgttaaaagggtttttgtcggaaagagctgattcaattaggcacaaactatctgatgctattgctgagtgtgttcaagacgacttaccagcatggccagaattactacaagctttaatagagtctttaaaaagcggtaacccaaattttagagaatccagttttagaattttgacgactgtaccttatttaattaccgctgttgacatcaacagtatcttaccaatttttcaatcaggctttactgatgcaagtgataatgtcaaaattgctgcagttacggctttcgtgggttattttaagcaactaccaaaatctgagtggtccaagttaggtattttattaccaagtcttttgaatagtttaccaagatttttagatgatggtaaggacgatgcccttgcatcagtttttgaatcgttaattgagttggtggaattggcaccaaaactattcaaggatatgtttgaccaaataatacaattcactgatatggttataaaaaataaggatttagaacctccagcaagaaccacagcactcgaactgctaaccgttttcagcgagaacgctccccaaatgtgtaaatcgaaccagaattacgggcaaactttagtgatggttactttaatcatgatgacggaggtatccatagatgatgatgatgcagcagaatggatagaatctgacgataccgatgatgaagaggaagttacatatgaccacgctcgtcaagctcttgatcgtgttgctttaaagctgggtggtgaatatttggctgcaccattgttccaatatttacagcaaatgatcacatcaaccgaatggagagaaagattcgcggccatgatggcactttcctctgcagctgagggttgtgctgatgttctgatcggcgagatcccaaaaatcctggatatggtaattcccctcatcaacgatcctcatccaagagtacagtatggatgttgtaatgttttgggtcaaatatctactgatttttcaccattcattcaaagaactgcacacgatagaattttgccggctttaatatctaaactaacgtcagaatgcacctcaagagttcaaacgcacgccgcagcggctctggttaacttttctgaattcgcttcgaaggatattcttgagccttacttggatagtctattgacaaatttattagttttattacaaagcaacaaactttacgtacaggaacaggccctaacaaccattgcatttattgctgaagctgcaaagaataaatttatcaagtattacgatactctaatgccattattattaaatgttttgaaggttaacaataaagataatagtgttttgaaaggtaaatgtatggaatgtgcaactctgattggttttgccgttggtaaggaaaaatttcatgagcactctcaagagctgatttctatattggtcgctttacaaaactcagatatcgatgaagatgatgcgctcagatcatacttagaacaaagttggagcaggatttgccgaattctgggtgatgattttgttccgttgttaccgattgttataccacccctgctaattactgccaaagcaacgcaagacgtcggtttaattgaagaagaagaagcagcaaatttccaacaatatccagattgggatgttgttcaagttcagggaaaacacattgctattcacacatccgtccttgacgataaagtatcagcaatggagctattacaaagctatgcgacacttttaagaggccaatttgctgtatatgttaaagaagtaatggaagaaatagctctaccatcgcttgacttttacctacatgacggtgttcgtgctgcaggagcaactttaattcctattctattatcttgtttacttgcagccaccggtactcaaaacgaggaattggtattgttgtggcataaagcttcgtctaaactaatcggaggcttaatgtcagaaccaatgccagaaatcacgcaagtttatcacaactcgttagtgaatggtattaaagtcatgggtgacaattgcttaagcgaagaccaattagcggcatttactaagggtgtctccgccaacttaactgacacttacgaaaggatgcaggatcgccatggtgatggtgatgaatataatgaaaatattgatgaagaggaagactttactgacgaagatcttctcgatgaaatcaacaagtctatcgcggccgttttgaaaaccacaaatggtcattatctaaagaatttggagaatatatggcctatgataaacacattccttttagataatgaaccaattttagtcatttttgcattagtagtgattggtgacttgattcaatatggtggcgaacaaactgctagcatgaagaacgcatttattccaaaggttaccgagtgcttgatttctcctgacgctcgtattcgccaagctgcttcttatataatcggtgtttgtgcccaatacgctccatctacatatgctgacgtttgcataccgactttagatacacttgttcagattgtcgattttccaggctccaaactggaagaaaatcgttcttcaacagagaatgccagtgcagccatcgccaaaattctttatgcatacaattccaacattcctaacgtagacacgtacacggctaattggttcaaaacgttaccaacaataactgacaaagaagctgcctcattcaactatcaatttttgagtcaattgattgaaaataattcgccaattgtgtgtgctcaatctaatatctccgctgtagttgattcagtcatacaagccttgaatgagagaagtttgaccgaaagggaaggccaaacggtgataagttcagttaaaaagttgttgggatttttgccttctagtgatgctatggcaattttcaatagatatccagctgatattatggagaaagtacataaatggtttgcataa

SEQ ID NO: 778 - DNA, 786 bp, Saccharomyces cerevisiae
atgacgcaagaattcattgataaagtatcttcctacctgactcctgatgtggacattgcacctatttctcaaggtgcagaagccattgttttcacaacgactactcacccatatctcccaagagcaaaggattctcatcaaaagtatattatcaaatataggccaccaaagcgttatagacatccacaaatagaccaggcactaacaaaacatcgtacgttgaatgagtcgcgtttattggccaaattatacttgattccagggctatgtgtccctcaactgatagcgtgtgatccatacaatggattcatttggttagagttccttggagaagatcttcccggagggcacggttttagtaacctaaagaacttcctttggatgcatgaccaagatccatatagtgatcttgtagcaactacactacggaaagtggggcgccaaattgggttgttgcactggaatgactactgtcatggtgatttgacaagttctaacattgttctcgtgcgagatggtgcgagatggacgcctcatttgattgatttcggtctgggctcagtttcaaacctggtcgaagataaaggcgtcgatttatacgtcttagagagagctattttaagtacacattcgaagcatgcggaaaaatacaatgcttggatcatggaggggttcgaagaggtctatcgtgaacaaggtgcgaaaggtgccaagaaactgaaagaagttaccaaaagattcgaagaggtcaggttgcgtggtcgtaagagaagtatgctaggataa

SEQ ID NO: 779 - DNA, 357 bp, Saccharomyces cerevisiae
atgaagctcccacagaccatgctacgttctatatctgtgaagcatgtccggtggccaaggattctgacgggctcaaagctttggtactcaacgcagatggcaatgactccggaggagaagatgatcaccgataaactacaacaggaactggaacctgaagtgtgtaaagtgcaagacgtttccggtggctgcggatccatgtttgctatcaacataacaagcaagaagttcaacggactgagtctcatcaagcagcaccagctggtgaacagaattttgagggacgatatttccagatggcatggcctacaattgaccactaagaagtcaactgggaagggtccggcatcatcatga

SEQ ID NO: 780 - DNA, 1461 bp, Saccharomyces cerevisiae
atgagcgaacaaaaggaagatttgtttaaaccagtaggagaagctgctgcagaggtcgaagatgaaagcatagccgaacagaacaaagctaatgacggcgtcaagttaaccggcgcacaggacgccatgggccatccagtgcaagagatagagtctctttgtatgaattgtggaaagaacggtacaaccagacttcttctgacttccatcccttatttcagagaaataattattatgtcattcgactgtcctcactgtgggtttaagaactgtgagatccaacccgcttctcaaattcaagagaagggctctcgttacgttttgaaagtggagtgccgtgaagattttaacaggcaagttattaagtcagaaactgccacttgtaagtttgtcgagctagacattgagattcctgctaagagaggtcaattgacgacagttgaaggtttgttatccgagatgatcgacgatctgtcgcaagaccaggaaatgagaaaatctatagacgaagctctttacaagaagatcgatgacttcatacagaaagttaaatcctacatcaattgtgaacccaacactattccgattacatttattttggatgatcctgcgggaaattcctggatcgaatacaaacccggtgaacctcaacacaaatggtctcatacccagtacgtgagaaccgacgaacaaaacgttcaagttggcattattactagagaccagttggagcaacgtcgccaagaacaattaaaacaattggccaaccgtgaaagaaatccttctgaatctgtcaaagttggctcagcaaacccacagtttttgtcagacgccaccgacatcgaaaactttaacaacgaggtgcaaacattcagagcttcttgtccatcgtgtacccaagagtgtgaaactcatatgaagccagtaaatatcccacactttaaagaagtcattatcatgtcgacggtctgcgatcattgtggttataagtctaatgaggtgaagaccggtggtgccatccctgacaaaggaagaaggattactttatactgtgacgatgcagctgacttgtcccgtgatattttgaaatctgagacctgtagtatggtaattcctgaattacatcttgatattcaagaaggtacattgggtggtagattcaccactttggaaggtttactaagacaagtctacgaagaactagaatcccgtattttcactcaaacttcggattccatggacgaagcaacgaaagcccgctgggtagaattttttgccaagctaaaggaggccatcgctgggaaagtcaagttcacagtcattatggaagatccattggccgggtcgtacatacaaaatgtctacgccccagatccggatccaaacatgactatcgaagattatgaaagaactaaagagcaaaatgaagacctgggattgtccgatatcaaggttgagtaa

SEQ ID NO: 781 - DNA, 1047 bp, Saccharomyces cerevisiae
atgtcacaatacaaaactggtttacttttaatacatccggcggtgactacaacgccagagctagtagagaacactaaggctcaagctgcatcaaagaaagtcaagttcgtggaccagtttttaatcaataaactaaatgatgggtccataactttggaaaacgcaaaatatgaaacagtacactatttgacgccagaagcccagactgatattaagtttccgaaaaagttaatttctgtcttagctgactcattgaaaccaaacggctcactaattggtttaagtgatatttataaagtagatgcattaatcaatgggtttgaaataattaacgaaccagattattgctggattaaaatggattcctctaaactaaaccaaactgtttctataccactgaaaaaaaagaaaacgaacaatactaagctacagagtggtagtaagctaccaacttttaaaaaagctagttcttcaacctctaatttaccctcattcaaaaaagcagatcacagtaggcaacctatagttaaggaaacagacagcttcaaaccacctagtttcaaaatgaccactgaaccaaaagtctaccgagtcgtagacgacctgattgaggatagcgatgatgatgatttctctagtgactcttccaaagcccaatattttgatcaagtggataccagcgatgattccattgaagaagaagaattaatcgacgaggatggttctggtaagtcaatgattactatgattacatgcggtaaatccaaaactaagaagaagaaggcttgtaaagattgcacctgtggtatgaaagaacaggaagaaaatgaaataaacgatataagatctcaacaagataaagttgtcaaatttacagaagacgagttgaccgagattgatttcactatcgatgggaagaaagttggcggctgtggttcttgttctctaggggatgcctttagatgtagtggttgtccctacttgggtcttcctgctttcaagcctggtcaacctatcaatttggacagcatttcagatgacttgtaa

SEQ ID NO: 782 - DNA, 1338 bp, Saccharomyces cerevisiae
atgtcccatgacggaaaagaagaacctggtattgccaaaaagataaactcagtagatgatattattatcaaatgtcaatgctgggtccaaaaaaatgatgaagaacgattagctgaaattttatccataaacacaagaaaagcaccaccaaaattctatgttcactatgttaattacaacaagcgtttagatgagtggattaccactgacagaataaacctggataaagaagtactatatccgaaactaaaggctactgatgaagataataagaaacaaaaaaagaagaaggcaacaaatactagtgaaacgccacaagactctctgcaagatggtgtagatggtttctcaagagaaaatacggatgttatggacttagataatctaaatgtacagggaataaaagatgagaacatatcacacgaggatgagataaaaaagcttagaacctccggctctatgacacaaaatccacatgaggtggctcgagttagaaatctcaatcgaatcattatggggaaatatgaaatagaaccatggtacttttctccatatcctattgaattaactgatgaagattttatatatatcgacgatttcacgttgcagtattttggatctaagaaacaatacgaacgctacaggaagaaatgtacattaagacatccgccaggaaatgaaatctacagagacgattatgtttcattctttgaaatcgatggtagaaagcaaaggacttggtgtcgaaacttgtgtttactttccaaacttttcctagatcacaaaacattatactatgacgttgatccgtttttgttttattgcatgacgagacgagatgagttgggtcaccatctggtgggatatttttccaaggaaaaagaatccgcggatggttacaatgttgcatgtatcttaacactaccacaataccaaaggatgggatatggtaagttattgattgaattttcgtatgaattgtcgaaaaaggaaaacaaagttggttctcccgagaaacctttgtctgatttgggtctcttatcctatagagcctattggtcggacactctcataacgctattagtggaacaccagaaggaaattactatagacgaaataagctccatgacttcgatgaccactacagatatattacacacagcaaagacactgaatatcctgcgatattacaagggtcagcatattattttcctgaatgaagatattttagataggtacaatcgacttaaagccaaaaagagaaggacaatagaccctaatagactcatatggaaaccaccggtatttactgcctctcagttacgctttgcctggtaa

SEQ ID NO: 783 - DNA, 681 bp, Saccharomyces cerevisiae
atgtctgctaacttagataaatccttagacgaaatcattggctctaacaaagcaggaagtaatagagcccgtgtcggtggtactcgtggtaacggtccaagaagagttggtaagcaagttggtagccaacgtaggagccttccaaacagaagaggccctatcagaaaaaatactagggcacctccaaacgcagtcgctagagttgccaagctcttggacaccactagagaggtcaaggtcaacgtcgaaggtttgccaagggacattaagcaggatgctgtaagagaattttttgcatctcaagtaggtggtgttcaaagagttttgttgagttataacgaaaggggccaatctactggtatggctaacatcacattcaaaaacggtgaattggccagaagggctgttgaaagatttaacggctctccaatcgatggaggcagatcaagattgagacttaacctaatcgttgatccaaaccaacgcccagtcaaaagtttagccgacaggatcaaggctatgccacaaaaaggcggaaacgctccaagaccagtaaagaggggtccaaatagaaaagctgctatggcaaaatcccaaaacaaaccaaagagagaaaagcctgctaagaaaagtcttgaagatctggacaaggaaatggcggactatttcgaaaagaaataa

SEQ ID NO: 784 - DNA, 1341 bp, Saccharomyces cerevisiae
atggacgacaaagtttcagaaaaggagagctccccaaaacaaacagaggaggattctgaaggtaaaatggcacatgtgcagcctgcttcgtacgtgaataaaaaaaaatatgtttttgggaagacattaggtgctggtacatttggtgtggtgagacaagccaaaaacactgaaacaggggaggacgtggccgttaaaatcctgatcaagaaagcactaaagggaaacaaggttcagctagaggctttatacgacgagttagacattttacaaagactgcatcatccaaatatagtggcatttaaggattggtttgaatcaaaagacaagttctacattatcacgcaattagccaaagggggtgaattgttcgataggattttgaagaagggtaagttcactgaggaagatgcagtgagaattttggttgaaatattgagcgcagtcaaatatatgcattctcagaatattgttcatagggacttgaaaccggaaaatttactgtatatagataaaagtgacgaatctccactggtagttgctgattttggtatcgcaaagagattgaaaagtgatgaggaactcctctataagccggcaggctcactgggttacgtggctccagaggtacttactcaggacggtcatggtaaaccttgcgacatttggtcgataggtgtcattacgtatactttgctttgcggttattcggcgtttagagccgaaagggttcaagatttccttgacgaatgcacaactggtgagtatccagtgaagtttcataggccttattgggattccgtttccaataaggcaaaacaattcatcttgaaggctcttaatttggatccttcaaagagaccgaccgccgcagaactcttggaagatccatggattatttgtaccgaattgaagacgcacaatttattgcctgggttaaaggaaggattggatgctcgtcaaaagttccgtaattctgttgagagagtcagattaaacatgaagatccagaaattaagagatctgtatcttgaacagacagagagtgattcagattttgacgaaggaagtcaagcaaacggttcagttcctccattgaaagcaacggataccagtcaactatccaagaagctatcagaagaagaacagtctaagttgaagtccgagttaaccagcaaagcttttgcacaattagttaacacagtgcttgccgaaaaggaaaaatttttaaatattaacagagtctgtagttctgatagcgatcttcctgggagtgatataaagtctttggatgaggcgaaggagaaaccagaggggaaggataccaaaacagaagaatga

SEQ ID NO: 785 - DNA, 2142 bp, Saccharomyces cerevisiae
atgactgccagcgtttcgaatacgcagaataagctgaatgagcttctcgatgccatcagacaggagtttctccaagtctcacaagaggcaaatacctaccgtcttcaaaaccaaaaggattacgatttcaaaatgaaccagcagctggctgagatgcagcagataagaaacaccgtctacgaactggaactaactcacaggaaaatgaaggacgcgtacgaagaagagatcaagcacttgaaactagggctggagcaaagagaccatcaaattgcatctttgaccgtccagcaacagcggcaacagcaacagcagcaacaggtccagcagcatttacaacagcaacagcagcagctagccgctgcatctgcatctgttccagttgcgcaacaaccaccggctactacttcggccaccgccactccagcagcaaacacaactactggttcgccatcggccttcccagtacaagctagccgtcctaatctggttggctcacagttgcctaccaccactttgcctgtggtgtcctcaaacgcccaacaacaactaccacaacagcaactgcaacagcagcaacttcaacaacagcaaccacctccccaggtttccgtggcaccattgagtaacacagccatcaacggatctcctacttctaaagagaccactactttaccctctgtcaaggcacctgaatctacgttgaaagaaactgaaccggaaaataataatacctcgaagataaatgacaccggatccgccaccacggccaccactaccaccgcaactgaaactgaaatcaaacctaaggaggaagacgccaccccggctagtttgcaccaggatcactacttagtcccttataatcaaagagcaaaccactctaaacctatcccacctttccttttggatctagattcccagtctgttcccgatgctctgaagaagcaaacaaatgattattatattttatacaacccggcactaccaagagaaattgacgttgagttacacaaatctttggatcatacttcagttgtttgttgcgtgaagttcagtaacgatggtgaatacttagccacaggctgcaacaaaactactcaagtgtatcgcgtttcagatggttctctggtggcccgtctatctgacgattctgctgccaataaccatcgaaattcgatcactgaaaataacaccaccacgtccacggataacaatacaatgacaaccactactaccaccacaattactaccacagcgatgacttcggcagcagaattggcaaaagatgtggaaaacctgaacacttcgtcttccccatcatccgacttgtatatccgttcagtgtgtttttctccagatgggaaatttttggcaacaggtgctgaagacagactgattagaatttgggatattgaaaatagaaagattgttatgattcttcaaggccacgaacaagatatttattcattggactactttccctcaggtgacaaattagtctccggttctggtgaccgtaccgttcgtatttgggacttacgtacaggccagtgttcattgactttatccattgaagatggtgttaccaccgtcgctgtatcaccaggtgatggtaaatacatcgctgctggttctctagatcgtgctgtgagagtttgggattccgagaccggattcttggtggaaagactagattcggaaaacgaatccggtacaggccacaaggactctgtttatagcgttgtcttcactagagatggacaaagcgttgtatccggctcattagatagatctgttaagctctggaatttgcagaatgcaaacaacaagagcgattcgaaaactccaaattccggcacttgtgaagttacgtatatcgggcataaagactttgtattgtccgtggccaccacacaaaatgatgagtacatcttgtccggttccaaagatcgtggtgtcctgttttgggataagaaatccggcaatccgttattgatgttgcaaggtcataggaattcagttatatctgtggctgtggcaaacgggtctccgctgggtccagaatataacgtttttgctactggtagcggtgattgtaaagcaaggatttggaagtataaaaaaatagcgccaaattaa

SEQ ID NO: 786 - DNA, 1521 bp, Saccharomyces cerevisiae
atggaatcgacagcaatagtgcctaaaggccctgttgtgggtagtgaagatatggagaaagcggaagtcattgctagtgggtccacagacattatatcaacaacatcaacagcgacaacaacggcggcgattggaagtgtacaggaagaaagtgtaaaacaagaagatgttcctatggaaggtggagagggggaagtcgaggaagaggaaggcgaaactcgctgtatctgtggagagctcgatactccagatgactccggatttttcattcaatgtgagcagtgcagttcctggcagcacggttattgtgtgagtattactcaagacaacgcacctgataaatattggtgcgagcaatgcagaccggagttacatcagctctttaccacagatactggcgaagcaaggtcaatctataaacctgtgcaagagaaaaggaggcaatcaagaaggaaggcacgaagtgcagctgcaagtaaatctcatgccgccaatgaagcagagaaaagtcccagaaataccagcaataccgatgataacgtcgacgatatcggcgacgaagaagatgaagtagaagatgaagcttcggctgtagcattagccaaggacggcaacacgaggtcaagtagaaggaggaggaggaattcaatggatgatgcttctaccgatcagtattcactggatcctggagatagtgataagaagctactggatagaaaaagggcaactttcatggcaagagaagaaaagcaatatcaaagaatgcttgaaaaagccttgaaagaaagcaggaggacatcacatcaagaagatcctgaaagttatgaaaatgatgctgatatataccaaggtgataccgacaatcacaacggcaccactcgattacaaacggatgttatgctaacggaaggcaaaccggactcggtaacaaatgatgatatgaaagaaagcctacgaccatcgaaagagcaatcaatggaaaaaacaaatgatgtggaaaaagaagctagtcaagaaaaggaatcttctacgggttcggcgcaagacactgagaaaactgatgaacccatcctacccctaacctcaatatcttcttctgaggatgattcaaggaaagctagttcgaggggttctaaaagagtttccaaaccagcaagaaagggcaacagaactcgtcgaagcaatacaagttcagacaccaaccaaaatagaaggagtgctgatataggtaccgacaaaccagtaaagcccagattaccccctcaaaggacctcattaaacgaaatgagaagaagggtatccgctattttggagttcatttctagaactcaatgggaattgagtgaagatcagtctgatcgagaggaatttgtacgattcgtggaaaaccagcatttcgtagaaaaagttgatacgatttacaacggttataatgaaagtctatcaatgatggacgacctgactagagagttactactatgggagaaaaaatattcaaataacactaatgccattcaataa

SEQ ID NO: 787 - DNA, 2901 bp, Saccharomyces cerevisiae
atgaatccgggcggtgaacaaacaataatggaacaacccgctcaacagcaacaacaacagcaacaacaacagcagcaacagcaacagcaggcagcagttcctcagcagccactcgacccattaacacaatcaactgcggaaacttggctctccattgcttctttggcagaaacccttggtgatggcgacagggccgcaatggcatatgacgccactttacagttcaatccctcatctgcaaaggctttaacatctttggctcacttgtaccgttccagagacatgttccaaagagctgcagaattatatgaaagagcacttttggtaaatcccgaactatcagatgtgtgggctactttaggtcattgttatctgatgctggatgatctgcaaagagcttacaatgcctatcaacaggctctctaccacctcagtaatcccaacgtaccgaaattatggcatggaatcggcattctttatgacagatatggttcgctcgactatgccgaagaagcttttgccaaagttttggaattggaccctcattttgaaaaggcaaacgaaatttacttcagactaggtattatttataaacatcagggtaaatggtctcaagctttggaatgcttcagatacattctccctcaacctcctgctcccttgcaggagtgggacatatggtttcagttgggtagtgttttggagagtatgggagagtggcaaggtgcgaaggaagcctacgagcatgtcttggctcaaaatcaacatcatgccaaagtattacaacaattaggttgtctttacggtatgagtaacgtacaattttatgaccctcaaaaggcattggattatcttctaaagtcgttagaagcagatccctccgatgccactacatggtaccatctcggtagagtgcatatgattagaacagattatactgccgcatatgatgctttccaacaagctgttaatagagattcaagaaaccctatcttttggtgctcaatcggtgttttatattaccaaatttctcaatacagagacgccttagacgcgtacacaagagccataagattaaatccttatattagtgaagtttggtacgatctaggtactctttacgaaacttgtaacaaccaattatctgacgcccttgatgcgtataagcaagctgcaagactggacgtaaataatgttcacataagagaaagattagaagctttaacaaagcagttagaaaacccaggcaatataaacaaatcgaacggtgcgccaacgaatgcctctcctgccccacctcctgtgattttacaacctaccttacaacctaatgatcaaggaaatcctttgaacactagaatttcagcccaatctgccaatgctactgcttcaatggtacaacaacagcatcctgctcaacaaacgcctattaactcttctgcaacaatgtacagtaatggagcttcccctcaattacaagctcaagctcaagctcaagctcaagcacaagctcaagcacaagcacaagctcaagcacaagcacaagcacaagcgcaagcacaagcacaagcacaggcgcaagcacaggcacaagcacaagcacaagcacatgcacaagcgcaagcacaagcacaagcacaggcacaagcacaagcacaggcgcaggcacaacaacaacaacaacaacagcaacaacaacaacaacaacaacaacaacaacaacaacaacaacaacaacaacaacaacaacagcagcagcaattacagcccctaccaagacaacagctgcagcaaaagggagtttctgtgcaaatgttaaatcctcaacaagggcaaccatatatcacacagccaacagtcatacaagctcaccaactgcaaccattttctacacaagctatggaacatccgcaaagctctcaactgccacctcaacagcaacaactacaatctgttcaacatccacaacaacttcaaggccagcctcaagcccaagctccccaacctttaatccagcataacgtggaacagaacgttttacctcaaaagagatacatggaaggtgcaatccacactttagtagatgccgccgtatccagtagcacccacacagagaataacacaaagtctcctcgtcaaccaacccatgccattccaacgcaagctcccgcaacaggaataacgaacgctgaaccacaggtaaagaagcaaaagttgaactctccaaattcaaacatcaacaaattagtaaatactgctacttccattgaagaaaatgcaaaatctgaggtgagcaaccaatcgccagcagtagtggagtctaataccaataatacttcacaagaagaaaaacctgtaaaagcaaactcaataccttcagtaattggcgcacaggaacctccacaggaagctagtcctgctgaagaagctaccaaagcagcttctgtttctccttctacaaaaccgcttaatacggaaccagagtcatctagtgtccaaccaactgtatcatcagaaagttcaacaacaaaagcaaatgaccaaagcactgctgagaccatagaactttctactgctactgttcctgcagaagcaagccctgtagaagacgaagtaagacagcattctaaagaggaaaacggcacaactgaagcatctgcaccttctactgaagaggcggagccagcagcttccagagatgctgaaaaacaacaagatgaaaccgctgctacaacgataactgtaatcaaacctactttggaaacaatggaaacagtgaaagaggaggccaaaatgcgtgaggaagagcaaacatctcaagaaaaatccccacaggagaacacacttccaagagaaaatgtagtaaggcaagtggaagaagatgaaaactacgacgactaa

SEQ ID NO: 788 - DNA, 282 bp, Saccharomyces cerevisiae
atggtcaccccaagagaacctaagaagagaaccactagaaagaagaaggacccaaatgcccctaagagggctttgtccgcctacatgtttttcgctaacgaaaacagagatattgttcgttctgaaaatccagatatcacatttggacaagtcggcaagaagttgggtgagaagtggaaggctctaacgccagaggaaaagcagccttacgaggccaaggcccaggccgataagaagagatatgaatccgaaaaggagttatataacgccactttggcttag

SEQ ID NO: 789 - DNA, 300 bp, Saccharomyces cerevisiae
atggccgcaactaaagaagcaaagcaaccaaaggaaccaaagaagaggaccaccaggagaaagaaggatcctaacgcccctaagaggcggttgtcagcttatatgttctttgctaatgaaaacagagacattgtccgttccgagaatcctgacgtaacttttggccaagtaggcagaatattgggtgagaggtggaaggccttaactgctgaagaaaagcaaccctatgaatctaaggctcaagcagacaagaagagatacgaatctgaaaaggaattgtacaatgctacacgtgcttga

SEQ ID NO: 790 - DNA, 2121 bp, Saccharomyces cerevisiae
atggattctgtaatggttaagaaagaagtactggaaaatccagaccatgatttaaaaagaaagctagaagagaacaaagaagaagagaatagcctctctactacttctaaaagtaaaaggcaggttattgttcccgtttgcatgccaaaaatccattattcaccgctgaaaactggtctttgctatgacgttagaatgaggtatcatgcaaagattttcacatcgtacttcgagtacattgatccacatccagaggacccaagaagaatatatcgtatttataaaatactagcagagaatggtctgattaacgaccccactttaagcggcgtggatgaccttggtgatttaatgctgaagatacctgtaagagccgcaacctccgaagaaatcttggaagttcatacaaaggaacatttagagtttattgaaagcacagaaaaaatgagccgagaagagttattaaaagagactgaaaaaggtgattccgtatatttcaataatgattcttacgcgagtgctaggctgccttgtggtggcgccattgaagcatgcaaggcggttgtcgaggggcgtgtaaaaaactctctagctgtcgtaagaccacctggccatcatgcagagcctcaagctgcgggtggtttttgtctcttcagtaatgttgctgttgctgccaagaatatcttaaagaactacccagaaagtgtaagaaggataatgattttagattgggatattcatcatggtaatggcacacaaaagtcattctatcaagacgatcaggtgctatatgtgtcattacacagatttgaaatgggtaaatactatcctgggaccatccaaggacaatatgatcaaactggtgagggtaagggtgaaggattcaattgtaatattacttggccggtcggcggtgttggtgatgcagaatatatgtgggcatttgaacaggtagttatgcctatggggagagaattcaagcctgacttggtgattatttcttcagggtttgatgccgcggatggtgatactatcggacaatgtcatgtcaccccaagttgttatggacacatgacacatatgttaaaatctctagctagaggtaatctttgtgtagttttggaaggtggatataacttggatgcgattgcaagaagcgctttgagtgtagcaaaagtactaataggggagcctcctgatgaactacctgatccattaagtgatcccaagcctgaggtcatagaaatgatagacaaagtaattcggttacagtccaagtattggaactgttttagaaggagacatgctaactccggttgtaattttaacgaacctattaacgactcgataatatctaaaaattttcctctgcagaaggctattcgtcaacaacagcaacactatttaagcgacgaatttaatttcgttactttaccgttagtaagcatggatttaccagataatacagtgctatgtactccaaacatttccgaatctaacactataattatagtcgttcatgatacttctgatatctgggcaaagagaaatgttatttcaggtacaattgacttatcctcatcagttatcattgataattctctagactttatcaaatggggacttgacaggaaatacggcatcattgatgtaaatatacctctaactctgtttgaacctgacaattactcaggaatgattacatcccaagaagttctaatatatttatgggataactacatcaagtattttccttctgttgccaaaattgcttttattggaataggagactcatactcaggtatcgtacatctgcttggtcacagggatactagggctgttactaaaacggtaattaatttcttgggagacaagcagttaaagccactagttcctctagtagatgaaacattgagtgaatggtacttcaaaaactcacttatattttcaaacaatagccaccaatgctggaaagaaaatgaaagcagaaaaccaagaaaaaaattcggtagagttttgagatgtgatacggacgggttaaacaatataattgaagaaagatttgaagaggctacagactttatactggattcgtttgaagaatggagtgatgaagaatga

SEQ ID NO: 791 - DNA, 1230 bp, Saccharomyces cerevisiae
atgggcaatatccttcggaaaggtcagcaaatatatttagcaggtgacatgaagaagcaaatgttgctaaataaagatggaacacctaagaggaaggtgggcagaccaggcagaaaaaggattgactctgaagctaagagtaggaggactgcccagaatagggcagctcaacgagcgttccgagataggaaagaagccaaaatgaagagtttgcaagagagggtagagttactagaacagaaagatgcgcagaataagactaccacggactttttactatgttctttaaaaagtttactgtcggaaattacaaaatatagagctaagaattctgatgatgaaagaatattagccttcctcgatgatctgcaagaacaacagaaaagggaaaacgaaaaaggaacaagtacagcagttagcaaggctgcaaaggaattgccatcgcctaattcagatgaaaacatgactgtgaacacaagtatagaagtacagccgcacactcaagagaatgagaaagttatgtggaacataggctcatggaacgctcccagtttaaccaattcgtgggattctccccccggaaatcgaacaggtgccgttaccatcggtgacgaaagtattaatggtagtgaaatgccagatttcagtctcgatcttgtctccaatgatagacagactggtctagaagctttagattacgacattcataactactttcctcagcactctgaacgcctgaccgctgaaaaaatagatacgtcagcatgtcaatgtgaaattgaccaaaagtatcttccatacgagacagaagatgatactttattccccagcgtgcttccccttgctgtagggagccagtgtaataatatttgcaaccgcaagtgtatcgggaccaaaccatgttcaaataaggagatcaaatgcgacttaataacaagccacctgttgaatcagaaatctctagcttcggtgcttccggtggctgcttctcatactaaaacaattcgaacccaatctgaagcaattgaacacattagcagcgccatatcgaatggaaaagcgtcttgctaccacattctcgaagagatctcctccctaccaaaatattcatcgttggacatagatgatttatgcagcgaattaataatcaaggcaaaatgtacagatgactgcaaaatagtagtcaaagctcgcgacttacagagtgctctggttagacagctcctgtag

SEQ ID NO: 792 - DNA, 1587 bp, Saccharomyces cerevisiae
atgaaattgtcttccgcttttgtattatctgctatcaccgttgccgctttaggcgaaagtattactactacgataactgctaccaaaaatgggcatgtttacaccaagactgtcactcaagatgctacttttgtctgggcaggagaaggcgctgcggtaacctccgcagtaactgaagcgtctactgtcgctgcaacgtctgctgccgctgaaacatctgttgccgctgaaacatctattgttgagccttccacttctgctcagggcacctctgctgatgaagggtctggttcgagtataaccaccactattacagccaccaaaaatggacatgtctacacaaagaccgtcacccaggatgctactttcgtatggactggagagggtgaacgtgctcctgcctcaactgttgctactgtcgaaacatctgttgccgctgaaacatctgttgctgaaccttctacctctgctcagggcacctctgctgatgaagggtctggttcgagtataaccaccactattacagccaccaaaaatggacatgtctacacaaagaccgtcacccaggacgctactttcgtatggactggtgagggtgaacgtgctcctgtctcaaccgttgctactgtcgaaacagctgcttctccagtaacatctgttgctgaaccttctgcctctactgatgaaggatctggttcgagtataactaccactattacagccaccaaaaatggacatgtctacacaaagaccgtcacccaggacgctactttcgtatggactggtgagggtgaacgcgctcctgcctccaccgttgcaacttctagtatttctgctattgaaattccctccactactgaggcctctattgtggaggcttcttctgctgttgagacttcctctgctgctgagacttcctctgctgttgagacttcctctgctgttgagacttcctctgctgttgagacttcttctgctgctgagacttcctctgctgctgagacttcctctgccgttgagacttcctctgctgttgagatttcttctgctgttgagacttctgctgttgagacttcttcttcttcctctactatcgagaccacttctgttaaaagcttatctcctactcagacttctctttcatcttctgtccaggcttcttctcctattgagacttcttctgctgcaaaaacctcttctgttgtgccaactttttcttctactactactgaaaattcctctaattctaaatccacgtctgcagttgtagcatctactaccacctcctctgagtcaagcgctactattgttactcctactagaattgggcaagcttacacagagagttcttctagggatgcccaatctgttcgtacccatgaaagtaacaattggtcatcaagttcttctgcaagcacaaaaatggtatcctctattacaagagttcaaaccactaccgctggtattttcactaacggtaagtcgtccacaactcctcaaatcgtgaattacacgggtgcggctgattctatcgccgctggtacgggtctgatgggcgctgcgctcgctgccgttatctttttgtaa

SEQ ID NO: 793 - DNA, 462 bp, Saccharomyces cerevisiae
atgaaattctcaactattttcggagctactacagttatgactgccgtctcggcagcagctgtgtcgagtgtaatgaccactaagactattactgctactaacggtaataacgtttacactaaggtcgttaccgacaccgctgaccctatcattagttacagtaccactagaactgtcgttgtcagtaatagtgatgctacttacacaaaggttgtcaccgaaggaccagataccacctctgaaaagagtacaacaaagacacttactttgacaaacggttcaggttcatcaaccaacctttacaccaagaccgtcactcaagccgtcgaatcatctacatcctcctcatcctcctcatcctcctcctcctcttctgcctcttcttctggtgctgctcctgctgcattccaaggagcaagtgtcggtgcattggcccttggtttgatttcttacctattataa

SEQ ID NO: 794 - DNA, 615 bp, Saccharomyces cerevisiae
atgaaattctcttccgctttggttctatctgctgttgccgctactgctcttgctgagagtatcaccaccaccatcactgccaccaagaacggtcatgtctacactaagactgtcacccaagatgctacttttgtttggggtggtgaagactcttacgccagcagcacttctgccgctgaatcttctgccgccgaaacttctgccgccgaaacctctgctgccgctaccacttctgctgccgctaccacttctgctgctgagacttcttctgctgctgagacttcttctgctgatgaaggttctggttctagtatcactaccactatcactgccaccaagaacggtcacgtctacactaagactgtcacccaagatgctacttttgtctggactggtgaaggcagcagcaacacctggtctccaagtagtacttctaccagctcagaagctgctacctcttctgcttcaaccactgcaaccaccactgctgaaacttcttcctctgctacatcctctagcaccgctgaattatctagttacaccggtgctgctgatgccatcaccgctggtactggtttgatgggtgctgcccttgctgccgtcatgttattgtaa

SEQ ID NO: 795 - DNA, 2061 bp, Saccharomyces cerevisiae
atggttagaacccgtgtattattctgcttatttatatctttttttgctacggttcaatcgagtgctacacttattagcacttcatgtatttcccaagctgcgctataccaatttggatgttctagtaaatctaaaagttgctactgtaaaaacatcaattggctgggttcagtgacagcatgtgcctatgagaattccaaatctaacaaaacactagacagcgccttaatgaagttagcatcccaatgttcaagcatcaaagtttatactttagaggacatgaagaatatttatttaaatgcgtcaaattatttgagagcacctgagaaaagtgataaaaaaaccgtggttagtcaaccgctcatggcgaacgagacagcgtatcattattattatgaggaaaattatggtatccatcttaacctaatgcgctctcaatggtgcgcttggggtctcgtcttcttctgggtggctgtgcttactgcagccactatcttgaacattctgaaaagggtgtttggtaagaacatcatggcaaactccgtcaaaaaatcacttatttatccttctgtttacaaagattataatgaacgaactttttatttatggaagcgtctaccatttaattttacaactcgaggcaagggtctcgtcgtattaatttttgttattttgactatattatctctcagttttggtcataatattaaacttccacacccatatgataggcccagatggagaagaagtatggcctttgtgagtcgtagagcagacttgatggccattgcacttttcccagtagtctatctattcggaataagaaataatcccttcatccctataacagggctttccttttctacatttaatttctatcataaatggtctgcctacgtttgtttcatgttggccgttgtacactcaattgtcatgaccgcctcgggagtgaaaagaggtgtgtttcaaagtctggttaggaaattttactttaggtggggtatagtggcaacgatattaatgtctattattattttccaaagtgaaaaagtatttagaaatagagggtatgagatattccttcttattcataaagcgatgaatattatgttcattattgccatgtactaccattgtcacaccctgggctggatgggttggatttggtcaatggctggtattttatgctttgatagattctgcaggattgttagaataatcatgaatggtggcttgaaaactgctactttgagtaccactgatgattctaatgttattaaaatttcagtaaaaaaaccaaagtttttcaagtaccaagtaggagctttcgcatacatgtatttcttatcaccaaaaagtgcatggttctatagtttccaatcacatccatttacagtattatcggaacgacaccgtgatccaaacaatccagatcaattgacgatgtacgtaaaggcaaataaaggtatcactcgagttttgttatcgaaagttctaagtgctccaaatcatactgttgattgtaaaatattccttgaaggcccatatggtgtaacggttccacatatcgctaagctaaaaagaaatctggtaggtgtagccgctggtttgggtgttgcggctatttatccgcactttgtcgaatgtttacggttaccatctactgatcaacttcagcataaattttactggattgttaatgacctatcccatttgaaatggtttgaaaatgaattgcaatggttaaaggagaaaagttgtgaagtctcagtcatatatactggttccagtgttgaggacacaaattcagatgagagtacaaaaggttttgatgataaagaagaaagcgaaatcactgttgaatgtctcaataaaagacctgatttgaaagaactagtgcgctcggaaataaaactctcagaactagagaataataatattaccttttattcctgcgggccagcaacgtttaacgacgattttagaaatgcagtggtccaaggtatagactcttccttgaagattgacgttgaactagaagaagaaagttttacatggtaa

SEQ ID NO: 796 - DNA, 2136 bp, Saccharomyces cerevisiae
atgcattggacgtccatcttgagcgctattttgcttttctgcctgtcaggagcaagagcatcacctgcaaagacagttattcgtaacaaggtgcccttgcttgtcactaatgcctgcacgaggatttttcaaaaagttacttgggagtataccagcaagtctaagcgttcatcaccagtatgttcttacgaaccagcgtttcaatcaatgctgtattgtatctatgaaacgttggatgaaaaaggttattcgaataaaaccttagaaaaaacatttagtaccatcaaaaaaaactgtgcaagttatagtgatgctcttcagaacatgactaattctgagttttatgacgttctaaacaacggaacgaggcatatgacgccctatgtcaaaggcagtgcaaacctaacatatccagttgaaatggatacacagttaagaaaagcctactatcatgcattgcatggtttctatgctaacttagatgtcggaaacatatatggtggcattatatgtgcttattttgtcgctatcatggcttttgcaggcgttcttcattgcatgaattacactccctttaaaactgttctattgaagcaaaagcttgtgggatatgtaaggggatacctcactctacctaccattggaagcaaacatgcgtcagatttctcttattttagaatattcacaggatatttacctacaagattagagggtatcattattcttggatatctcgtgcttcataccgtttttttggcatacggttatgaatacgatcctgaaaatataatattcaagtctcgtagagttcaagttgctcgatatgtggcagacagaagtggtgtactcgcattcgcacactttccattaatagttcttttcgcgggaagaaacaactttctcgagtatatttctggggttaaatatacttccttcattatgtttcacaaatggttgggaagaatgatgtttttggatgctatgattcatggctctgcatatactagttatacggtagcgaataaaacttgggcaacaagtaaaaaccgattatattggcaattcggggtggcagcactttgtttagctggcacaatggttttcttttcctttgcagtattcaggaagtatttttatgaagcctttctttttcttcatatcgtccttggtgcaatgttcttttatgcatgttgggagcatgttgttagtttaagtggcattgagtggatatacactgctattgcgatttggatcgttgaccggattattagaattatcaaagcttcttattttggtttccccaaagcttccctacaactaatcggggatgatctcattcgtttaacagttaaaaaaccggcaaggccatggagggccaaacctgggcaatatgttttcgtttcgtttttacatccactgtacttctggcagtcacatccatttactgttttggattcagtaagcaagaatggtgaactggttattatcctgaaagaaaaaaagggagtaacaagacttgtcaaaaagtatgtgtgtcgcaatggaggtaagacatctatgagactagctatagaaggtccatatggttcttcatctccggtcaataattacaataatgtattgttactcactggaggtaccggtttgcctggacctattgcacatgcaattaaacttggaaagacgtcagcggctgctggaaaacaatctgtaaaattagtgattgcagttagaggattcgacgtactcgaggcttataagccggagttgatgtgtttagaaaatctgaatgtacagcttcacatctacaacacaatggaagtcccatcattaacccctagtgatagtttagatatttctcaacaggatgagaaggctgatgaaaaaggcactgttgtggcaactactttagaaaagtctgccaatccacttggttttgatggtgttgttttccattgcgggcgaccaaatgttaaggaacttctacatgaagcggctgaattgagtggctcattatctgtggtttgctgtggacctcctatttttgttgacaaagtgaggaatgaaaccgcaaaaatagttttagataagtctgcaaaagccattgagtactttgaagagtatcaatgctggtga

SEQ ID NO: 797 - DNA, 2136 bp, Saccharomyces cerevisiae
atgtattgggtcctcctttgtggttctattttgttatgctgcttgtcaggagcaagcgcctcccctgctaagacaaaaatgtacggcaagttaccactggttttgacagatgcctgcatgggagttctcggcgaagtaacctgggagtatagtagtgacgatttatattcctcaccagcatgtacatatgaaccggcattacagtcaatgttgtattgtatttacgaatcattgaatgaaaagggttattccaatagaacctttgaaaaaacctttgctgctatcaaagaagactgcgcatattacactgataaccttcagaatatgactaatgcagatttctataatatgctgaataatggaacaacatacataatacagtattctgaaggtagcgcgaatcttacgtatccaatcgagatggatgcccaagtgagagaaaactattattattcttaccatggtttctacgccaactacgacattggtcatacttatggtggtattatttgcgcctattttgtaggtgttatgattcttgccagcatactccattatctaagttacactccgtttaaaactgccttatttaaacaaagacttgtaagatatgtgagaagatatttgacaatacctactatctggggtaaacatgcgtcgagcttttcttaccttaaaatttttacaggcttccttcccacacgatctgaaggcgtcattatacttggatacctcgtgcttcatacagtttttctggcatacgggtatcaatatgatccttacaacttaattttcgactctcgtagagaacagattgctcgatacgtggcagatagaagtggtgtcctggcatttgcacattttcccctaatagctcttttcgcaggaaggaacaattttctagaattcatttctggagtaaaatatacctctttcataatgtttcataagtggttgggaagaatgatgtttttagatgctgtgattcatggcgctgcttataccagttattccgtattctacaaagattgggcagcaagcaaggaagagacatattggcaatttggagtagctgctctttgtatagttggtgttatggtgtttttttctttggcaatgttcagaaagtttttctatgaagccttcttatttctccatattgtgcttggcgcattgttcttttatacgtgttgggagcacgtcgtagaattgagtgggattgagtggatatacgctgctattgctatctggactattgataggctaattcgaattgttagagtatcttatttcggtttccctaaggcttccttacagttagttggcgatgacatcattcgagtcacagtcaaacgaccagtaaggctatggaaagccaaaccaggacagtatgttttcgtttcattcctacaccacctgtatttttggcagtcacatcctttcacagtcttagattcaattatcaaagatggtgagctgactattatcctgaaggaaaaaaagggagtaacaaaacttgtcaaaaagtatgtgtgttgcaatggaggtaaggcatctatgagactagctatagaaggtccatatggctcttcatctccagtcaataattatgataacgtcttgctacttacgggaggtactggtttgccagggcccattgcacacgccattaaacttggaaaaacgtcagcggcaactggaaaacaattcataaaattagtgattgcagttagagggtttaacgtactcgaggcttacaagccggagctgatgtgtctagaagatcttaatgtacagcttcacatctacaatacaatggaagttccggcattaactcctaatgatagtttggaaatttctcaacaagacgagaaggccgatggaaaaggtgttgttatggcaactaccctagaacagtcacctaatccagttgaatttgatggtactgtttttcatcatggaagacccaatgttgaaaagcttctgcatgaagttggtgacctaaatggatcgttagctgtggtttgttgtgggcctcctgttttcgttgacgaagtaagggatcaaacggcaaatcttgttctagagaagcctgcaaaggcaatcgaatactttgaagaataccaaagttggtaa

SEQ ID NO: 798 - DNA, 2160 bp, Saccharomyces cerevisiae
atgttgttggtacatattatatctttccttctgttcttccagctttcggccgcaaaggccccacccagtaaaacgtctctaataaatactcatgagagaaggtcgatatattcatgctacgttggtttacgtaaagaaacatgggggttcaatgggtccgctatatgtcggtatgaaccagcaatccaatcgatgctttactgtctttacgaagacacgcatgagaaagggtattcaaataaaactttggagaaaggttttgaagaaatgagacaattttgctatacaccaaagtttttgaacatgactgatgccgagttttacacctcattggataatggaacatactatatacaagatcaacctaaagctggcatcaatatcacttatcctatcagactgaacactacactaagaaaagcatactatgatgcatactatggttactactataaccatgacattccgtattatttcgggggcattatctgtgcatactttgtgggtgtcatgttgcttgcaggtttaattcgttttttgaattataccccaataaaaaagattatgtttcagcaaaagctagtcaattacgtgagaggttatactactctacccactctttatgaaaagcatgcagagcccttctcgtacttaaaagtgataacaggctatcttcctactaggtttgaaacgttggttattttaggctacctcatacttcataccattttcatggcctacaaatatcaatatgatccataccacatcatatttgccgctcatagagcagaagtggcacattttgttgcgtacagaagcggtatactttcttttgcacacctgccactcattgttttatttgcgggaagaaataactttctccaacttatttctggcttgaagcatacctcattcattgtgttccataagtggctgggaagaatgatgtttcttgatgcaataattcatgctgccggctttacgaactattatttgtattataaaaaatggaatacggttagattaagagtctactggaaattcggtattgctaccacctgtttagcgggaatgttaattttcttttccatcgcagcatttagaagacactactatgaaacgtttatggccctccatatagtattcgcagcactatttctctatacttgttgggagcatgttactaacttcagcggtatcgaatggatttacgcggcaatagcaatttggggagttgatagaattgtacgtatcaccagaattgcactcttaggatttcctaaagcagatctacaactggttggatctgatttggtccgtgtaacggttaaaaaaccaaagaagttttggaaggcaaaaccaggccaatacgttttcgtttccttcttgcgtccattgtgcttctggcagtcgcatccatttacagtgatggattcttgcgtaaacgatagagaattggtcatcgttctgaaagcaaagaaaggtgtgacaaaactggtaagaaactttgttgaacgtaaaggcggcaaggcatccatgagattagctatcgaaggcccttatggctccaagtccaccgcccatcgctttgataatgtattattgttggcaggtggctcagggcttcccggtccaatttctcatgcccttgaattaggaaagacaacagctgcaagcggtaaaaactttgtacagttagtcatagcagtaagaggactagacatgctcaacgcgtgtaagaaagaactaatggcattaaagggcttgaatgttcaagttcacatttataattctaagcaagagctagcttcggctgaaaaaatttcctcaaatgaagtcaaaaacggtgaaacgacagcagagaaggccccatctagtctaagcaattcagaaaaagctccttctgaaagtgaaaatacagaactacctctttccctgaatgacacgtctatctccgatttagaatttgccactttccatgttggaaggccaaatgttgaagaaatactaaatgaatctgttaaccattctggttcacttgccgtcgtatgttgcggaccacctattttcgtcgacaccgctagaaatcaaactgccaaagctgttatcagaaacccatcaagaatgattgaatacttggaggaataccaagcctggtga

SEQ ID NO: 799 - DNA, 2085 bp, Saccharomyces cerevisiae
atgcttttcgctagattagtgctgctgttggtgtatttggcaccaggttctttagcaaaaccagcatcaactaagaaaagaacgcaatgggaccagatagcaattgatgcttgtgctaaagaattggaatcacacaaatttgacacggatgtgaagggtcggcacgctactctttgcacttatgaaccagcactagggtcttggttacattgcgcgaaggatgttctcgacagtaggaagaaaagtaaaaaaatattcgaaaaaacgtttagcaaaattaatcagtattgccacgattatcacaaagatgaggtcgtcagcaatgaggagtattatcgaatttttgccaatgcatcccttttcatccggcctcttgatgaggtaaaggaaaacatacgatatcccgtcactcccaataaagcctctctagataggtgggtatgggcttattttgggcccctggataatatagacaaaggaaatgtttatggagtgacgatttgcttatactggataggagttctgtttattgcagctgtatatcacttcttgaacttttctcgacttaaacaaacggtgttcaaaaacaaggtgtctgctttcttaagaggccactatgttcttccagcgcttgttcataaccatgctatgtcagtgggaaggtggtttttcatcggtctggtccctaccaggttagagacccttgtcctattcggttacgttttgttgcacgggttcttgttgagtagttacaattttgaccataatgagttgctcagtgatcgcagaagccaagtgcttatcttcctttccgacagggcagggatcctggcattcgcacattttcctttgatagttctctttggcggtaaaaacagcacaatgacttggctcacaggtataagatataccgcattcattacttaccacaaatggttaggaagattcatgttagtagactgtacgatccatgcaataggatacacctaccatgcatacatagaaaattactggaaatacgtgaagtatagtgatctatggacatccggaagacatgccatgatcattgttggaatacttgtgtttttttcgttcttcttctttagacgacattattacgaattgtttgttattacgcacattatcttagcaataggatttttccatgcgtgctggaaacattgctataaacttggatggggtgaatggataatggcgtgtgcactgttttggattgctgaccgtattctgcggctaataaagattgcaatttttggaatgccatgggctaaattgaaactgtgtggcgagtccatgatagaagtgagaatctcaaaaagctccaaatggtggaaagcagaacctggccaatatatatatctgtacttcttaagaccaaaaatattctggcaatcacatccattcacggtcatggattctttggttgaggatggtgagttggtagttgtgataacagtgaaaaatgggctaaccaaaaaattacaggaataccttttagagagcgaagggtacacggaaatgcgagtactagcagaaggaccttatggacaaagcacgcgaacacatttgttcgaaagcctcctgtttattgccggaggggcgggtgttcctggacctctgtcgatggcaataaaggcaggtcgccaggtcaaaagcaacgattctcatcaaatgatcaaatttgtgtggagtgtacgtaaccttgatctcttagaagtgtatcgcaaagagataatggtgctaaaagagttgaacatagacacaaaaatttacttcacaggagagcgaaaagatgaatcgaacacggaggagggagcaattgctaatatgagcacggaaggcagactgctgacgacatcgaaatcagcggaaatgattactgattttggacgaccaaatatcgatgagataattgaagaagcagtaagtggtgcaaaatctttgttggtcacttgttgcgggtcagagggctttgtagacaagacacgagagttgacggcaaaaagagttcttgaacacggtgacaaatggatagaatacgtggaggaattccagaattggtag

SEQ ID NO: 800 - DNA, 1911 bp, Saccharomyces cerevisiae
atgactaacgctttgctctctatagccgttttgcttttctcgatgctctcgctagcacaagcggagacgcacacgtttaattggaccactggctgggactacaggaacgttgatgggctaaagagccgtcccgtgatcacctgtaatggccagttcccatggccagatataacggtcaacaaaggtgaccgtgtgcagatttacttgaccaacggaatgaacaacaccaatacttctatgcatttccacggtctcttccaaaacggaaccgcctctatggacggtgtgcccttcttgacgcaatgtccaattgcgccaggcagtactatgctttacaatttcacggtggactacaatgtaggcacctactggtaccattcacacacggacggtcaatatgaagacgggatgaaaggtcttttcatcatcaaggatgatagcttcccctacgattacgatgaggaactttctttatcgcttagtgagtggtaccacgacttggtcacggacttgacgaagtcgttcatgagtgtttataatccgacaggtgctgagcccatcccacagaacttgattgttaacaacacgatgaatctgacatgggaagtccagcccgatacgacgtatcttttgagaattgtcaacgtgggtgggttcgtttcgcagtacttttggatcgaggaccacgaaatgaccgtggtcgaaatcgacggtatcactaccgagaagaacgtaacggatatgctttacatcactgtcgctcagagatatacagtcctggttcacactaaaaacgacacggacaaaaatttcgccatcatgcagaaatttgatgacaccatgttggatgtcattccaagtgatttacagctgaatgcaacctcttatatggtctacaacaaaaccgctgcgctgcccacacaaaattacgtggattcaattgataacttcttggacgatttctacttgcaaccgtacgagaaagaagccatctatggcgagccagatcatgtgattaccgttgacgttgttatggataacttgaaaaacggtgtgaattacgccttcttcaataatatcacctatactgcaccaaaagttcctactttgatgaccgttttgtcttcaggtgatcaagcaaacaactccgaaatctacggttcaaacacgcacactttcatcctagagaaggatgaaatcgtggagattgtgctaaataaccaggacacaggtacccatcctttccatttacatggtcacgctttccaaaccatccagagagatcgtacatatgatgatgccctaggtgaagttcctcacagtttcgatccggacaaccaccctgccttcccagaatacccaatgagaagagatactttatacgttagaccacaatccaatttcgtcatcaggtttaaagccgataacccaggtgtttggttcttccattgtcatatcgaatggcatttgttgcaaggtttgggtcttgttctcgtggaggatccttttggtatccaagatgctcattctcaacaactcagtgaaaaccacttagaagtttgccagagttgctctgtggccactgaaggtaacgccgctgccaatacactggatttaactgatttaactggtgaaaatgttcagcatgccttcattcctaccggttttaccaaaaaaggtattattgccatgacattctcctgctttgccggtattcttggtattatcacaattgcaatttatggtatgatggatatggaagatgcgaccgaaaaggttattcgagacttgcacgtggaccctgaagtcttgctaaatgaggttgatgaaaatgaagagcgtcaggtaaacgaagatcgtcattccactgaaaagcatcaatttttaactaaagccaaacggttcttctaa

SEQ ID NO: 801 - DNA, 1215 bp, Saccharomyces cerevisiae
atgcctaacaaagtgtttaacgtggccgttttcttcgttgtgttcagagagtgcttggaagcagtgattgttatttccgtgctgctatcgtttttgaaacaggcaatcggggaacatgaccgggcgctgtaccgtaaattaaggattcaggtttgggtcggtgtgttactcgggttcatcatttgtctggccatcggtgcaggtttcatcggtgcgtactattcgctgcagaaggatattttcggaagcgcggaagacttgtgggaaggtatcttttgtatgattgcgacgataatgatctcgatgatgggtattcctatgttgagaatgaataagatgcagagtaagtggagagtgaagattgcgcggtcgttggtggagattcctcaccgtaagagagactatttcaagattgggttcttgagtagaagatatgctatgttccttttgccgtttattactgtcttgagagaaggtttggaagctgttgtgttcgttgccggtgcaggtattaccacacagggctcgcacgcctctgcttacccattgcccgttgtggttggtttgatatgtggtggtcttgttgggtatttgttgtactatggtgcttcgaaatcctcgctgcagattttcttgattttgtctacttcgatcttgtacctgatctccgccggtcttttctctcgtggtgcgtggtactttgaaaattacagattcaaccttgccagtggtggtgatgcttccgaaggcggtgatggtaatgggtcttataacatcagaaaggccgtttaccatgtcaattgttgcaacccagaactggacaatgggtgggatatcttcaatgctttgcttggatggcagaacaccggctacttgtcatccatgctttgttacaacatctattggttggttcttatcattgtgttgagtttaatgatattcgaagaaaggcgtggtcacttgcctttcaccaaaaacttacaattgaaacacttgaacccaggatactggatcaagaacaagaaaaagcaggagttgacggaagagcaaaagagacaactgtttgccaagatggagaacatcaacttcaatgaagatggtgagatcaatgtgcaagagaactacgaacttcccgagcaaactaccagtcattcctcgtctcaaaacgtcgccacagacaaggaagtcctccacgttaaagccgactctctttga

SEQ ID NO: 802 - DNA, 222 bp, Saccharomyces cerevisiae
atggcagagataaaacattatcaattcaatgtcgtcatgacctgctcgggatgttctggtgcagtcaataaagttttgacgaaattagaaccagacgtttccaaaatagatatatcccttgaaaagcaattagtagatgtatatactacacttccttacgattttattttagaaaagattaagaaaaccggaaaggaagttagatctggcaaacaattgtga

SEQ ID NO: 803 - DNA, 3015 bp, Saccharomyces cerevisiae
atgagagaagtgatacttgctgtacatggaatgacatgcagcgcctgtactaatacaatcaatacgcagttacgagctttaaagggtgtaacaaaatgtgatattagtttagtgactaatgagtgccaggtgacatacgataacgaggttaccgccgattctattaaggaaattatagaggattgtggatttgactgtgagatactaagagattctgaaattacagccataagtacgaaggaaggactactgagtgtacaaggtatgacctgtgggtcttgtgtttctacagtcaccaaacaagtggaaggcattgagggtgttgaatcggtagtcgtttccttggtaacggaagagtgccatgttatttatgaaccgtccaagacaacgctagaaaccgccagagaaatgattgaagactgtggatttgactcaaatattattatggatggcaacgggaatgcagacatgaccgaaaaaacggtgatcttgaaagtaactaaggctttcgaggacgaatccccactcatactttcttcagtaagcgaaaggtttcaatttttgttagacctaggtgtaaaatcgatagaaatttctgatgatatgcacacactcaccataaaatactgttgtaacgaactcggcattagagatttattgaggcaccttgagaggaccggatataaattcactgtattttccaatttagataatactacccagttaaggcttctctctaaagaggacgagataagattctggaaaaaaaacagcataaaatccacccttttggctataatatgtatgctattgtatatgattgtccctatgatgtggccaacaattgttcaggaccgcatattcccttacaaagaaacctcctttgttagaggtctgttctacagagatattttgggtgtaatattggcaagctatattcagttcagcgttggtttttacttttacaaggcagcatgggcatctttaaagcacggttcaggaaccatggatacactagtttgtgtttccactacttgtgcatacacattttctgtgttttctttagttcacaatatgttccatccctcaagtactggcaaactcccaaggatcgttttcgacacatcaatcatgatcatttcatatatttccatcgggaaatatttggaaactttagctaaatcacaaacatcaaccgcactttctaaattaattcagctcactccatcggtgtgttcaattatatctgacgtggagcggaatgaaaccaaggaaattcccatagaattattgcaagtgaacgatatagtggagattaaaccagggatgaaaattcctgctgatggcatcataacaagaggtgaatctgaaattgacgagtcgttaatgacaggcgaatccattttggtgcccaagaaaactggttttccggttattgctggttctgttaatggacctggacatttctacttcagaactactaccgttggggaggaaactaaattagcaaatattatcaaggtaatgaaagaagcacaattgagtaaagctcccattcaggggtatgcagattatttagcctctatttttgttccggggatcctaattttggcagtattgactttctttatttggtgttttattttaaacatctcggctaatcctcccgtcgctttcaccgcaaatactaaggctgataatttttttatttgcttacaaactgctacttctgttgtcatcgtcgcatgcccatgtgcattgggacttgccacgccgactgctataatggtgggtacaggggttggagctcagaatggtgtcttaataaagggcggagaagtattggaaaaattcaatagtattactacttttgtttttgataaaacaggtaccttaactacaggttttatggttgtgaaaaagttccttaaagattcaaattgggttggaaacgtggatgaagacgaagttctcgcctgtataaaagcaacggaatccattagtgaccatccagtttcgaaagcaattatacgttattgtgatggtttgaactgtaataaggctttaaatgccgttgttttagaaagcgaatacgtgcttggaaagggaatagtctcaaagtgtcaagttaatggaaatacttatgatatttgtattgggaacgaggcgctgattttggaggatgcattaaaaaaatccggatttattaacagtaatgtcgaccaaggaaacactgtatcatacgtatcagtaaacgggcatgtgtttggcttgttcgagattaatgatgaagttaaacatgattcttacgcaacagttcagtatctacaaagaaatggatatgaaacgtatatgattactggcgataataactcagcagcaaaaagagtcgctagagaagtaggtataagcttcgaaaatgtttacagcgatgtgtcacccacaggcaaatgtgatctcgtgaaaaaaattcaagataaagaaggtaataacaaggttgctgttgttggcgatggcattaacgacgctcccgctttagcactgagtgatctaggtattgccatttcaacaggtacggagattgctattgaagcagctgatattgttatactgtgcggtaatgatctgaatactaatagtttgagaggactggccaacgccatcgatatttcactaaaaacgttcaaaagaataaagctgaatttgttctgggcactttgctataatatattcatgattccgattgctatgggtgtgctcattccttggggcataactcttcctccaatgctcgccggtttagcgatggcattcagctcggtcagtgtcgttctaagttcattgatgttgaagaagtggactccaccggatattgaatcacatgggatttcagatttcaagtccaaattttcgattgggaatttttggtcaaggcttttttctacgcgggctattgcaggtgagcaagacatagaatcacaggccggactaatgtcaaacgaagaagtcttgtaa

SEQ ID NO: 804 - DNA, 2340 bp, Saccharomyces cerevisiae
atgccaacaacttatgtgccaataaatcaaccaattggggatggtgaagatgtcattgacaccaatcgattcaccaatattccagaaacgcaaaattttgaccaatttgttacaattgataagattgctgaggaaaatagaccactgtctgtagactcggacagggagttccttaattcaaaatatcgacattaccgagaggttatatgggaccgtgcaaaaacatttatcacattaagctctacggccatagttattggatgtattgctggtttcctacaagtcttcacggaaactctggttaactggaaaacaggtcattgtcagaggaactggctacttaataaatccttctgttgtaacggcgtggttaatgaggttacctctacaagcaatttactactgaaaagacaagagtttgaatgcgaggcacaagggctttggattgcctggaagggacatgtgtccccttttataattttcatgcttttgtcagtcttatttgctctaattagtacactgttagtcaaatatgttgctcctatggctactggttcaggaatctcagagattaaggtatgggtatcaggttttgaatacaataaggaatttttgggtttcttaacattagtcattaaaagtgttgcccttcctttggctatttcttcgggattaagcgtaggtaaagaagggccctcagttcattatgcaacctgttgtgggtacttactcacaaaatggctactaagagatactttgacgtattcatcgcaatatgagtatatcacagcagctagtggagcaggtgttgcggttgcttttggtgctcctattggtggtgtcctttttggtttggaagagattgcttctgcgaataggtttaactcctctaccttatggaaatcctattatgtcgccctagtcgcaataactactttgaagtacattgatccatttaggaatggcagagttattttattcaatgtaacatatgatagagactggaaggtacaagagattccgatctttatagccttaggaatctttggtggtttatatggaaaatatattagtaagtggaacatcaactttattcactttcgcaaaatgtacctgtcctcatggccagttcaagaagtgctttttttggcgacgcttactgctttgatttcttacttcaatgagttcttgaaattagacatgacagaaagtatgggtatattgtttcatgaatgtgtcaagaacgataacacctcaacttttagtcataggttatgtcagttggatgaaaatacgcacgcttttgagttcttaaaaatttttacttccctatgctttgccactgttatcagggccttgttggtggtggtatcatatggcgccagagttcctgccggaatctttgttccttcaatggcggttggggccacatttggacgggcagtaagtctactggtagagagatttataagtggcccttctgttattactcctggtgcctacgccttcctgggagcagccgctaccttgagcgggataactaacttgactttaactgtggtggtaataatgttcgagctaacaggcgccttcatgtatatcataccccttatgattgtagtggcaataacaaggataattttaagcacgtctggtatttctggcggtattgctgatcaaatgatcatggttaatggattcccatatttggaagacgagcaagacgaggaagaggaggaaaccttagaaaaatacactgcagagcagctcatgtcctccaaattaattactattaatgaaaccatttacctttccgagcttgaatctttgttgtacgactcagcgtctgaatattctgtgcatggttttccaataactaaggatgaggataagtttgagaaggaaaaaagatgtattggctatgttttaaaaaggcacttagccagtaaaatcatgatgcaaagcgtaaatagcaccaaagctcaaacgacactggtatacttcaataagtctaacgaagagttgggacatcgtgaaaactgcatcggatttaaggatattatgaatgaatctccaatctcggtgaagaaggcggtgccagtaacattgttattccgtatgtttaaagagctaggttgtaagactatcatcgtagaggaaagtggaattttaaaggggttggtcactgctaaagatattttgaggttcaaaagaattaagtatcgagaagttcacggtgcgaaatttacatataatgaagcacttgatagaagatgttggtcagttatccatttcataatcaaaaggtttaccactaatcgaaatggtaacgttatatga

SEQ ID NO: 805 - DNA, 1884 bp, Saccharomyces cerevisiae
atggagtctgttcactctcgcgatcctgttaaggaggaaaagaaacatgtcttcatgggaatggaacacgagttgaatcctgagactcataacgattccaactccgactcatatggtctccctcagttatctgaaaaatacaatgccttgagacagaacaggagcctaattatccagcagactgaaatcattggctctgcttacaataaatggtacttacaagcgattttacttttgagtgctttcatatgtggctacggttatggactggacggtaacatccgttatatttacactggttacgccacatcatcctatagtgagcattctctgctgtctacaatcaacgtcattaatgctgtggtcagtgccgcttcgcaaatcatatacgctaggttgtctgatgtgtttggtagactataccttttcattagtgctgtcatcctatatgttgtgggtacaattattcaatcacaagcttatgatgttcaaagatacgctgcaggtgccattttctacaatgctggctatgtgggtgtaatccttattcttttgattatcctatccgatttttcatctttaaagtggagactgctgtatcaatttgtcccgacttggccttttatcatcaacacatggattgctggtaatatcacttccagagccaatcctgttgtcaactggtcttgggatgtaggtatgtgggctttcatctttcccctatcatgtgttccaatcgttttgtgtatgttgcacatgcaatggagggccagaaagactcctgaatggcacgctttgaagggccagaagtcctattatcaagaacatggttttattaagatcttaaagcaattattttggatgttagatgtcgttggtgtccttttgatgggttgttccctaggttgtatcttggtcccactgaccttggctggtggggtcaaaactacctggaatgattcaagattgatcggcccctttgttcttggctttgttttgatccctatcttatggatttgggaatatcgattcgctagagatccaattcttccatataggctggtcaaagatagggctgtatggtcttctatgggtatttctttcctgattgattttatttactatatggccgctgattatttgtacacggttatgattgttgccgtcaatgaatccgttaaatctgcaaccagaattgccacattatcttcatttgtctctactgtggcctctccatttttcgctttacttgtaacaagatgtacgagattgaaaccattcataatgtttggatgcgcgctatggatggtggctatgggtttattgtaccactttagaggtggaagtcagtcccattcaggtattattggtgcattatgtgtctggggtgtgggcactactttgttcacttacccagttaccgtctctgtacaatctgccgtctctcatgaaaacatggcgacagttacagctttaaactataccctctatagaattggttctgctgtcggttccgcagtttccggtgccatttggactcagactttgtacaaacaaattttgaagagaatgggtgatgttgctctagccacaactgcctacgaatctccatatactttcattgaaacctatacttggggtaccccacaaaggaatgccttaatgaacgcttacaaatacgttcaaagattggaaactatcgtggctttagtattttgtgttccattaattgcattctccttatgtctaagggatcctaaattgactgatactgttgctgtggaatacatcgaggatggcgaatatgtcgacacgaaagacaatgatccaattttggattggtttgaaaaacttccatcaaaattcacttttaaacgggaataa

SEQ ID NO: 806 - DNA, 1914 bp, Saccharomyces cerevisiae
atgatcgaagtcccagaagacaatcgttctagccaaacaaagcgtaagaatactgaaaaaaattgtaatgaactgatggttgatgaaaagatggatgacgattcgtcgcccagagatgaaatgaaagataaattaaagggaacaaaatcattgattattcgtaagtctgagctaatggctaaaaagtatgatacttggcaattaaaagctatattcctgttttctgcattcatttgcactttcgcttatggattagatagcagcataaggggtacatatatgacctacgcaatgaactcgtactccgcacattctctcatttctacagtaagcgtcatagttctaatgatatctgctgtttcacaggtgatctttggagggttatcagatatctttggaaggctaacgttgtttcttgtatccattgtactttacattgtgggtacaataattcaatctcaagcatatgatgtccagaggtatgctgctggagctgtcttttattatgtgggacttgtcggtgttatgctacaggttgttttgatgttgtctgataattcttcattaaaatggaggctattttacacattgataccttcatggccctcgattatcactacgtgggtctcaggtagtgtagtggaggcagcaaacccgttagagaactggtcgtggaatattgctatgtgggcgttcattttccctctatgctgtatcccattgattttgtgtatgctccatatgagatggaaagtaagaaatgacgtggaatggaaagaattacaggatgaaaaatcgtactatcaaacgcacggattagtacaaatgctggtacagttgttctggaagctagatgttgtcggtgtgttgttgtttactgctggtgttggttgtattcttgtaccactcactcttgctggtggcgtctctacaaattggagaaattcaaagattatcgggccctttgtgcttggctttgtcctggttccaggcttcatatattgggaaagtcgacttgctttggttcctttcgctccattcaagctgctaaaagatcgtggcgtgtgggccccattgggaattatgttttttatctgctttgtatatcaaatggctgctgggtatctctacaccattctagtagttgcggtagatgagagcgcttcctcagctacaagaataataaacttatactcttttgtgactgctgttgttgctccatttctggggctcatcgttacgagatcatctagattgaagtcgtatattatttttggtggctcactttatttcattactatgggactattttaccgctacaggtcaggtcaagacgccgatggaggtataattgctggtatggttatttggggtctcagtagttgtttattcgattatcctacaattgtttctattcagtcggtaacatcccatgagaatatggctactgtcacagcattaaactatacagttttcagaataggtggagcagttgcagctgccatttccggtgccatatggacgcagtcattgtaccctaaattattgcactacatgggagacgctgacctggctacagcagcatatggctcaccactaacttttattctttccaatccctggggtactccagttaggtctgcgatggttgaagcttacagacacgttcaaaaatacgaagttattgttgcgcttgtattttcagcgcctatgttccttctaacattctgcgtaagagatcctcggttgactgaagattttgcccaaaagttacctgacagagaatatgtccaaaccaaggaagatgatcctatcaatgactggatcgcgaaacgttttgcaaaggccttaggaggtcataagaaagatttacaaaaccccaacaggatatgtgttcgaaaaaatgatctctga

SEQ ID NO: 807 - DNA, 1887 bp, Saccharomyces cerevisiae
atggaccctggtattgctaatcataccctccccgaggaatttgaagaggttgtcgttcccgagatgctggaaaaggaagtaggagccaaggtcgatgtcaagccaacgctaaccacatcttctccagcaccttcttacattgaattgatagatccaggtgtgcataacatcgagatttacgcagaaatgtacaaccgcccgatctaccgtgtcgcattattcttctcacttttcctcattgcctatgcttacggattagatggtaatatccgttacactttccaggcgtacgcgacttcgtcgtactcccagcactcgctgctatcgaccgtcaactgtattaagacggttattgcggctgtaggccagatcttctttgccagattatcagatatcttcggcagattttccattatgattgtcagtatcattttttatagcatggggaccatcattgagtcgcaagcggtgaatattacaagatttgcagttggtggttgtttttaccaattgggtcttaccggtattattctaattttggaagttattgcttctgacttttccaacttgaactggaggttgttagccttattcattccagctttaccatttatcatcaacacctggattagcgggaacgtaacaagtgccatagatgctaattggaaatggggtattggtatgtgggcttttatactgccgctagcttgtattccgcttggaatttgtatgttgcacatgaggtatttagcaagaaagcatgctaaagatagattgaagcccgagttcgaagcgctaaacaaattgaagtggaagtccttttgtatagacatcgcattttggaaattggatatcattggaatgttattaattactgtatttttcgggtgtgtattggttccattcaccttagcgggtggtttgaaagaggaatggaaaactgcgcatattattgtccctgaagtcattggttgggttgtagtgttaccactgtacatgctatgggaaataaagtactcgagacatccattgacaccttgggacttgattcaagatagaggtatctttttcgctctactcatcgcattctttatcaattttaactggtatatgcaaggtgattacatgtatactgtactagtcgttgcagttcatgaatccataaagtccgctacaagaattacctccttgtattcatttgtttctgttatcgttggtacaatcctcgggttcatactgattaaagttagaaggactaagccttttattatatttggcatttcttgttggatcgtctcatttggtttgctggtccattaccgtggtgactccggtgctcattccggtatcattggctctttgtgtctattaggtttcggtgcaggttcatttacctatgtgactcaagcttccatccaagcatccgctaaaactcatgcaagaatggcggtagtaacctcattataccttgccacttataatattggttctgcatttggtagttctgttagcggagctgtctggactaatatcctacccaaagaaatttcaaaaagaatttccgatccaaccttagctgcacaagcgtacggttctccatttacattcattacaacttatacctggggaacaccagaaagaatagctttagtcatgtcttaccgctatgttcaaaagattttatgtatcataggtttggtattctgctttcctttgttaggttgcgcattcatgttgagaaatcataaactaacagattctattgctcttgaaggcaatgatcatttggaaagtaaaaacacctttgaaattgaggaaaaggaagaaagttttttgaaaaataaattctttacgcactttacaagcagtaaagataggaaagattaa

SEQ ID NO: 808 - DNA, 1821 bp, Saccharomyces cerevisiae
atgctggaaactgatcactctaggaatgacaatttagacgataaaagcactgtctgctacagcgaaaagacagatagcaatgttgagaagtctaccacgtctggcttgcgccgtatagacgctgtcaacaaggtcttgtctgactacagctctttcacagcttttggagttacgtttagttcactcaagaccgccctactggtggctctgtttttgcagggttactgtactggactcggagggcagatttcgcaatcaatacaaacctatgccgctaacagttttggaaagcattctcaagtaggatcgatcaataccgtcaaatcaatagtagcctctgttgtcgcagtgccatacgcacgtatatctgatcggtttggacgtatagaatgctggatttttgcgcttgtgctctatactattggagaaattatttctgctgctactccaacgttttccggactttttgcaggtattgttatacaacagttcggttattctggatttcgtcttcttgctacagcactgactggtgatctgtctggattgagagatcgtacatttgcgatgaacatatttctgattcccgtgattataaacacatgggtaagtggaaatattgttagctcagttgctggtaatgttgcaccatataaatggcgttggggctatggaattttttgcatcattgtgcccatctccaccctaatattggtccttccctatgtgtatgctcagtacatttcctggcgcagcggtaagttaccaccattaaaattgaaagaaaaaggacagaccctgcgtcaaacgctctggaaatttgcggatgacataaacttaattggagtcattcttttcactgctttcttagttttagtattattacctctcacaatagctggtggagccacctccaaatggagagagggtcacattattgcaatgattgtggttggtggctgcttaggttttatctttctaatttgggaattaaaatttgctaagaatccatttatcccacgagtatatctaggtgatccaaccatctacgttgcattgctaatggaatttgtatggcgtctaggtttgcagattgagttagagtatttggtcaccgtgttaatggtagcattcggagaatcaacattaagtgcgcagcggatagctcagctttacaattttctacagtcatgcactaatattgttgtcggcattatgctgcatttctatcctcatccgaaagtctttgtagtcgctgggtcgcttcttggtgtcatcggaatgggtcttttgtacaaatacagggtggtatatgacgggatttcgggtcttattggcgctgagattgtggtcggtatagctggtggtatgatacgttttcctatgtggacgctagtgcacgcttcaaccacccacaatgagatggcaactgtcactgggttactaatgtccgtttatcaaatcggagacgcagtaggtgcttccatcgctggtgctatatggactcagcgtctggcaaaggagttgatacagcgactcggctctagtttagggatggcaatctacaaatcaccactcaattatctaaaaaaataccctattggatcagaggttcgtgttcagatgatagaatcctattcgaagattcaacgcttattgataattgtgtccatttcgtttgcggctttcaatgctgttctctgttttttcttgcgtggctttactgtaaacaagaagcaaagtctttccgcagaagaacgagagaaagagaagctcaaaatcaaacaacaatcatggctccgtcgtgtaattggatattga

SEQ ID NO: 809 - DNA, 1659 bp, Saccharomyces cerevisiae
atgggtaaaattgcagagtttctcgggaatccaggtgctaggcctgacgttcatcatagagcacctactgttgactgcaaacagtacgaagaattcggtgattctaacgattacaaaaatgatgatgtggtcagagtagtcagccatagcgatgagagtactgatgacgaactttgtaatgtgaatttaacagaaacaggggcaatcttcacgagtaaaggttttaccgggttaagcaaaggtttcacagataagaccctggatttcctggtacgagtggccggttcgcaggcggttttttttattgtttggatcatcctcataatttgggtggttattggtattgtttataacgcacctttcaattggcaagttgttatgcaggacggacagtctattcaaagttatgtttgggacacactgttgatgagacaacagttgatgagtacgcatgaacaaattttgatctgcggtagattgaagtcgagattggcttccttcaaaaactatctaacaagaagcaccccagaggaagaaaaagcagactgcacagttgaagctaatgaagtcagctctgttgaaaatcatatagacccatctgccattaacggagaactgcctgtggaaaattggtacgaccgtttatctaacgtagcaagtaggtatatgggttcaattgcagcaatggtgatattttggataggtattttcgtttggattggttgcggtgctatcccaaaagatgcgggcaacactccaccttacaccggagaaactacaggtagtaatccaagattgaaaaagttcagtgacgcttggcagatgtatattaacactgcagttgcagtttcccttctaatttgcactactttcttacaaaatataagggctagacatgattatttcacggggaggtttttagttgatatctttgatatggacgagaaaatcgactatcgtataagaaagcattttaacgattttgaaacacctcacccagttgttactattgaatctaaaaaaaggtcgacagggagaaagatgattgattggtatgctgatattattggtactggtattggtgtcctgattggtgtggcagtgttcgccacatggattggtattggttcgccaatgaagtgggatgataattggtggttgattatcggtacatacacaggtttaattgggtttttggacggtttcgttttgagagaagtgtacttccgaatcgttcaacatgaagagaaaaattattctgatgtggctaaagaagaccttgaattattccaagaattaggtattgaatgtcccgaagaatttagtggtaaagctcctgaaattaacactattggttacagaacatcccaatatattaataggatctgctcaactccatggagtgttcttgtatccgtcatcatcatcattggtttaatttgtattgcttccggtttgcgttggagtacaacaggtcaattgattgctaacacgccaactatgattatcgaagaatttttcttgctagttttgttgcaagcacataattgggccgatcgtcaaagaagagtggaggttaccgctttgtacgcacgtaggcgcatacttctatcatacgtagaaaagcgtttcccagaggttatgatgttggaaaaatag

SEQ ID NO: 810 - DNA, 1728 bp, Saccharomyces cerevisiae
atggtgaacgttggtccttctcatgctgcagttgctgtggatgctagcgaagcccgcaaaagaaatatttcagaagaagtattcgaactgagggataagaaagattctacagtggtaattgagggtgaagccccggtaagaacttttaccagtagctctagtaaccatgaaagagaggatacgtatgtttctaaaaggcaggtaatgagagatatttttgctaaatacttgaagttcattggacctggattgatggttagtgtggcttacatcgatcccggtaattactctactgccgtcgatgcaggtgcctctaatcaattttccctactttgtatcattttgttatcaaactttattgccatatttttgcaatgtctgtgtatcaagttgggttccgttacgggactagatctaagtcgagcttgcagagagtatttaccacggtggctcaactggacattgtatttttttgcagaatgtgccgttatagccaccgatatagctgaagtgattggtacagcgattgccttgaatatcctgatcaaagtgccccttccagcgggcgtggccattactgttgtggatgtgtttttgattatgtttacatataaacctggtgcgtcatcaattaggttcattagaatatttgaatgttttgttgcagtattagttgttggcgtgtgcatttgtttcgcaatagaattggcttatatcccgaagagtacgtccgttaaacaagtgttcagaggatttgtgccatctgcccaaatgtttgaccacaatggtatttataccgctatttccatcttaggtgctactgttatgccacattcgttgtttttgggttccgctttagtgcagccaaggcttttagattatgacgttaaacacggtaattatactgtttctgaagaacaagataaagtgaaaaaatctaaatccactgaagagattatggaagaaaaatattttaattatagacccacgaacgctgctatcaaatattgcatgaaatattctatggtcgaattaagcataactctcttcaccctagcgcttttcgtcaattgtgccatcctagttgttgcgggctccactctatataactcaccagaagcagatggggcagatttgtttactattcatgaattattatcaagaaatctggcacccgcagcaggtacgattttcatgctcgcacttttattaagtggtcaatccgcaggtgtagtgtgtactatgtcgggtcaaattgtaagtgagggtcatattaattggaagttgcagccatggcaaagaagattggccactagatgtatttcgataatcccttgtttggtcatctctatctgtatcggtagagaagctttatcaaaggccttaaatgcttcccaagttgttttatccatagttctgccatttttggtagcacctttaattttcttcacatgtaaaaaatcaatcatgaaaaccgaaattaccgtcgaccatactgaagaagatagccataaccatcaaaataacaacgatagatctgcaggtagcgtaatcgagcaagatggttctagtggcatggagatagaaaatggaaaagatgtcaaaatcgtttatatggcaaacaattggattatcactgttattgctataattgtgtggcttttcttatctttactgaacgtttatgccattgttcaattaggcatgtctcatggtgatatcagttaa

SEQ ID NO: 811 - DNA, 969 bp, Saccharomyces cerevisiae
atgtccattgtagcactaaagaacgcagtggtgacccttatacagaaagcgaaaggtagtggtggaacctcagagttgggggggtctgaatcaactcccttgttgaggggtagtaatagcaatagttcaaggcatgataacttatcctcatctagctcggatattatctatggtagaaattcagcgcaggatctagaaaactcaccgatgtcagtagggaaagataataggaatggcgataacggttcggataacgaaaaggcgaacctagggttcttccaatcagtagatcctcgcgtaattagcgatttgattatcgggctaagcgacggtttaaccgtcccctttgctctaacagctggtctatcttcacttggtgatgcgaaattggtcattaccggtggctttgctgagttgatctcaggtgcgatttctatgggccttggtggctatttgggagcgaagagtgaatctgattattatcatgctgaagtaaagaaggagaaaaggaaattttacgataactccaacctaattaacagagaaattgaagacattctgttagagattaaccctaatttctcggacgaaacaatcgtttcgttcatcaaagatttacaaagaacacctgagctaatggttgacttcattatcaggtacggtaggggtctagacgaacctgccgagaatagagaactaatcagtgcagtcactatcggtggcggttatctacttggtgggctagtaccactagtgccatatttttttgtctcagatgtgggcacaggtctcatttattctataatagtcatggttgtaacattattctggtttggttacgtaaagacaaaactatccatgggtagtggcagttcgacttcaaagaaagttacggaaggtgttgaaatggttgttgtgggtggtgtagcagcaggtgcggcttggttctttgttaagttactgggttaa

SEQ ID NO: 812 - DNA, 738 bp, Saccharomyces cerevisiae
atggctctacctctgataaaacctaaggagtctgaggaaagccacctcgctcttttgtccaagatccacgtgtccaaaaattggaaactgcctccaaggttgccccatagagcagctcagcggaggaaaagagttcatcgacttcacgaagattacgaaactgaagaaaatgatgaggagctacagaagaaaaaacggcagaatagagacgcccaaagggcctacagagaacgcaaaaacaacaagttgcaagtgctggaggaaaccatagagtcactgagtaaggtcgttaaaaactacgaaacgaaactaaaccgcctccaaaatgaacttcaagcgaaagaatcggaaaatcatgcccttaaacagaaattggagacccttactctgaaacaagcctctgtgcctgctcaggaccctatcctgcagaatttgatcgagaatttcaaaccaatgaaggcgatacctattaagtacaataccgctatcaagcgccaccagcactcgacagaactgcctagctctgtcaaatgcggcttttgtaacgacaacactacttgcgtttgtaaagaactggaaacagatcaccgtaaaagtgacgacggtgtggccacagaacagaaggatatgtcgatgccacatgcagagtgcaataataaagataaccccaatgggctctgtagtaattgtactaatatcgacaaatcatgtatcgacatccggtccatcatccactga

SEQ ID NO: 813 - DNA, 1398 bp, Saccharomyces cerevisiae
atggcgtttgaggattatttttctttccagatattcttcattttcttaaggaaatccttagaaattgttgtcattgtttctatcctgttgacgatcgtcaaacaagatctgtctgttgaggacgacagcccgtttgaaggaagttcctcttctgctggtcttccaagtccaaatacgaacacaaacgcagattcgaccactgccttcttacaagcagggccttcagacggtaatgctattggaacgtccgctacggctgctaataataaatcgaggccgctaaatgtggaggaagaagaagaaatttacgagtactctaatgagcttagagaccaggaccgcgagtccgatgaacatacggctgacaacgttaagctatatcagaaattaaaaatacaaattctagcgggcggcgcatttggtttgttgctgtgtatgttaatcgggggtgcgtttgttagtatcttttatcatattggaaccgacttatggacactgagtgaacattattatgaaggtgtcttaagtcttgtcgcgtccgttattatttctgtcatggggttgttttttttaagaatggggaagttaagagagaagttcagagtgaaattagcttctatcatttattcaaaggacaataatttgctgggaaacaaaacccaaaaaggtgtgaaattcagtcaaaagtactccttcttcatattaccatttataacgactttgagagaagggttagaagctgtgtattcaattggaggtatcggtattgaccaaccactatcctcgattcccctctctatggtccttgctactgcaatcagtacggtgttcggtatttttttcttcaggtactcaagttctctttcacttaagatatgccttgtagtcgccacctgcttcctctacttgatcgcggctggtttgttttccaaaggtgtatggcaacttgaattgcaagactacgtcaacaaatgtaacggtcaagacatgagtgaagtagaaaatggacccggttcgtacgacatatctcgttctgtttggcatgttaattgttgcaatggtgaaaaagatggaggttggatgatttttactgccatttttggttggacgaatagtgctaccgtcggctctgtaattagctacaacgcctactggttggtattaaaatacgctttgaagcttctaatgatagaaggaaaatgcggatatatcccatatctacctattagctggcaaaagaaacgtattatgaaaagattaagcattgccaaggcatcgctcgatctcaaacatcatacttctgaactcaactctagcacatcagagccagacagtcaaagacggtccaaagatagttctgtgcccctaataattgatagcagtggttcagcaaattga

SEQ ID NO: 814 - DNA, 1869 bp, Saccharomyces cerevisiae
atgttgttctactcgttcgtgtggtctgtactggccgctagtgttgctttggcaaagacacataagttaaactataccgcttcttgggtaactgccaatcctgatggattgcatgaaaaaaggatgattggttttaatggcgaatggccacttccagatatccatgttgaaaaaggagatcgtgttgagctttatttgactaacggctttcaagacaatactgctacttctctacatttccatggtcttttccagaatacgagtttggggaaccagcttcaaatggatggtccttctatggtgacacaatgtcccatcgttccgggacaaacatacctgtacaacttcactgtcccagagcaggtaggaacgttctggtaccatgcacacatgggtgcccagtacggtgacggtatgaggggtgcatttatcatccacgatccggaggagcccttcgaatatgatcatgaacgagtcatcactctatcggaccattatcacgaaaattataaaacggttaccaaagagtttctgtcaagatataatccaaccggtgctgaacctattcctcaaaatattctttttaataatacgatgaatgtaactttagattttacacccggtgaaacgtatctcttcaggttcttgaacgttgggctgtttgtatcccagtatatcattcttgaggatcatgaaatgagtatagtagaggtggacggtgtttacgtaaagccaaactttactgattcgatatatctttctgcggggcaaagaatgagtgtgttgattaaagctaaagataaaatgcctacaagaaactacgctatgatgcaaataatggatgagacgatgcttgatgttgtcccacctgagttacaactcaaccaaactatccaaatgaggtatggccactcgttgccggaggcacgcgcattgaacattgaagattgtgacttggaccgcgccacgaatgacttttacctagaacctctgattgagagagacctacttgctcactatgaccaccaaattgtcatggatgtaagaatggtcaacttgggtgatggtgtgaagtatgcatttttcaataatatcacttacgtcacaccaaaggtgcctactttgacaacgttgcttacctcaggaaagcttgcgtcagatcctagaatttatggtgataatatcaatgcgcagttattgaaacataatgatatcatagaggttgttctaaacaattatgattctggcagacatccattccatttgcacggtcataatttccaaatagtccaaaagtcgccagggttccatgttgatgaagcttatgacgaatctgagcaagatgaaatgaccgtcccttataacgaatctgcgccattacaaccgttccctgagaggccgatggtgagagatacagtggttcttgaacctagtggacatgttgtcctgagatttagagctgacaaccctggtgtctggtatttccattgtcatgtagattggcacttacaacaaggtttggcttcggtctttattgaggcacccgttttacttcaggaaagggaaaagcttaatgagaactatctggatatatgcaaagccgctgatattccggtagttggtaatgctgcaggtcattcgaatgattggtttgacttaaaaggattaccaagacaacctgagccactaccaaagggatttactactgaaggatatttggcattgattatttcaaccattatcggtgtctggggcctatattccattgctcagtatggtattggcgaggttatccctaacgatgagaaggtgtaccacacgttaagggaaatcttggctgaaaatgaaatagaggtttctcgcggctaa

SEQ ID NO: 815 - DNA, 1422 bp, Saccharomyces cerevisiae
atgcgatcttatatgcagattcttcaaaaatttgccaaatttattgggccagggatattagtcagtgtggcttatatggacccaggaaattatgccactagtgtttccggtggtgctcaatacaaatataccttattattctctatttttatatccaacatttttgccgtacttttgcaatgtctctgtgtgaagctgggtactatcactggctatgatttggctgaaaactgtcgtcataatttgcctaaaaagctaaactataccctttaccttttcgctgaagtggcaatcattgctactgatctggccgaggttgtaggcactgccatcgctttacaaattcttttcaaaataccactaacttggggtgtcttattaacggtgctagatgttttggtaattttaatgttctacacaccaaacggccagtccttaaaaaaagttagggttttcgaatttggcgttgggattttggtcattggaacttgcatttgctttgttttggagctgtttaaagtttcaatcccagacaaagctgaattgtttaaagggtttttgccttcaaatatcatttttaaggaacaacaagctctttacatttcattgggtatcttaggtgccactgtgatgcctcattcattatacttgggctcatccattgttaaaccaagattgcacgattacgatttgaagaaatacggtaaggttaatgcccgcccaagtttaagcgctataaaatatacgttaaactatgcgtacgctgaactaatcatttctttgttcttaattgccacctttgttaattccgctattttaattgttgcaggtgctactttatcaggccaacctgaggcagaggatgctgatttgttatctatttacaaattactggtccactacatatctcctgcggcagggttaatctttgcattggccatgttatgttctggtcaatctgccggtatcatctgtacacttgccgggcaaatcgtttctgagggatttttacagtggtctttaccaccttgggccacaagattgtgcaccagattgattgccattgtaccatgtttatttgttactttaaccatgggggaaaagggaatttcagatattttgaatttttctcaagtggtcttgtccttaattttaccaatcgtttccgctcctttaatttattttaccgcaaatagaaagttgatggttgttcatgacgaaaatggtgtggtaagagcacctgccgatgttaacgccattgctgatgaaaccactccattgaactccaagcacagtaaaatagttgattttactaacagtcgtttgttgacctatacctctgttttcgtatgggctttaatcgggagcttgaattgctatttggtgatttcctatctcttaggtgccgacatccatttttaa

SEQ ID NO: 816 - DNA, 1320 bp, Saccharomyces cerevisiae
atgaaactcggaagcaaacaggtaaaaattatatccttgttgctgctagacacagtgttcttcgggatcgagataactaccgggtacttgtctcactctttggctctaatcgcggactcattccatatgctaaacgatataatttctcttgtggttgcactttgggccgtaaatgttgccaaaaacagaaatccggattcaacgtacacttatggttggaaaagggcggagattttgggtgctctgattaacgccgtctttttgattgccttatgtgtctcaattttgatagaagcgctacaaagaattattgctccccccgtgattgaaaatcctaagtttgtgttgtatgtgggtgtcgcagggttgatatcgaacaccgttggacttttcttatttcacgacaatgatcaagagcatggacatggacacggacattcccatggcggtatctttgccgaccatgagatgcatatgccatcatcccacacacatacacatgcccatgttgatggaatagagaatactacaccaatggatagtacggataacattagtgagattatgcctaatgctatagtagatagttttatgaacgaaaatactagattattgacaccggaaaatgcatccaagacgccatcatactcaacgtcaagccatacgattgccagcggcggaaattacacagaacacaacaagcgcaagagatctttaaatatgcatggtgtgtttcttcacgttttgggcgatgctcttggcaacatcggcgttatgttgtctgcatttttcatttggaagaccgactattcttggaagtattatacagatccgcttgtctcattgataattaccggtataattttttcctctgcgcttcctctatcgtgcaaggcttccaaaatattgttacaagcgacaccttccactttatccggcgatcaagtagaaggtgatcttttgaaaataccaggaataatagctattcatgatttccatatttggaatttaacagagtctatttttattgcatctttgcatattcaactagatatcagcccggaacaatttactgacctggccaaaatagttagatcaaaacttcaccgctatggcattcactccgctactttgcaacctgaatttattaccagagaggttacttcaaccgaaagagccggagactcccaaggtgatcatctacaaaatgacccgctttcattaaggccaaagacatatggtactggcatttcaggttccacttgtcttatcgacgacgctgccaactgcaacacagctgattgcttagaggatcattaa

SEQ ID NO: 817 - DNA, 2139 bp, Saccharomyces cerevisiae
atgcatagaacgcttctgtttttaacgtggctgatatctttaacaaaggcttttaatataaaattaccacacactgaaaaaaaagaccatttggaatccaacgctgtgctggcatgcgcatcctatataaatactctgaagtggtcatttgatagctccgtcgtaccgggtttctattctaccatatgctcttattcaccagcgtttgatacttggtcactttgtatcttcaattcgcttacagaccagattattcccatggacaacacaagtttcgaagaaagcttgggtaacgtacgaaaaacgtgctcgtttgtcgataaaaagtttagcaatatttcactggagcaatactactcatctttaaataatgcttcttctcacgctttggaagactatggttctattgaaagtttatcgacatccattcgagtcgatcgtgagacaagatctagatggatacgagcttttcatgcgcatgcctataatttagatatcagcagtgtttatggtgcatatttaacttactacttcgtcatagtgggtattatcgccgtcttcttccatatgagtcactataacggcctgaatcgagcgctatttgcaagccggttcgtcaattatattcggggccattttgtgttgcctacgtttttagtagataagcacgctaatcacttcaagtttctaaacgtggaagtctttacgggactgatgccgaattccttggaggcatggatcatttttggatacacattggcgaacatcatatttttgtccataagttacatcatagacccatataacctcattttcaacagtcacctgtcgcagtttacaagactgttggctgatagatctgggatactggcgtttactcagttccctctcattatcatttttacggcaaggaatagttttctcgaatttttaacaggagtcaagttcaattcctttattagtttccataaatggatcggtagaatcatggtcttaaacgcaacgatacattcgctttcttattcattattcgcaattatcaaccatgccttcaaaataagcaacaaacagctctattggaagtttggtattgcatccataacagtgctttgcgttctactagttctatcgctcggaatagtaaggaaaagacattacgaatttttcctgtacacccacatcatactagcccttttgttcttttactgttgttggcaacacgtcaaaattttcaacggttggaaagaatggatagtggtatccttgctcatttgggggctggaaaagcttttcagaatatggaacattttgcagtttagatttccgaaagcaacactaatcaatttgaacaccagcaacaacccgcacgatgaaatgtttaaagtaatcatacccaaatataaccggagatggcattcgaaaccgggtcaatattgtttcatttattttttacatccattggtattttggcaatgccatccatttaccattatcgacgaaggtgagaagtgtgttttagtgatcaaacctaaaagtggtctcactagattcatttataaccatattttgcaatctttaaatggtaaattacaactccgagtggccattgagggaccttatgggcccagtaatcttcacctcgataaattcgaccatttgctgttactaagtggaggaacaggcttgcctggtccattagatcatgccattaagctgtcacgaaaccctgataaacccaagagtatagatttgatcatggcgatcaaaaatccttcttttcttaacggctataaatccgagatactagagctaaaaaatagccgatcccacgtcaacgtgcaggtttaccttacacagaaaacagctgttacaaaggcagcaaacgcacgagaccaattaatacattttgatgatataatgaccgaactgacaagcttcgcccacatcggcaatgcaagacctaattttagcaatgtaattgaaaacgcaataaaaagtacgccgcctggagattcattagcggtcgtgtgctgcggccctcctgttctggtggacgatgttagaaacaccgtttctcaaaaactcctcggttacccagagagaattatagagtatttcgaggaatatcagtgttggtaa

SEQ ID NO: 818 - DNA, 915 bp, Saccharomyces cerevisiae
atgaatacttcagaactgtcaatagctgaggaaatcgactacgaagctcttccatcacatgctccgctacattcccagttactggcaggagcatttgcaggtataatggagcattctttgatgtttccaatagatgctctgaaaacccgagtgcaggctgcaggattgaataaagctgcctctacagggatgatatctcagatatccaaaatatctacaatggaaggttcgatggctttatggaagggtgttcaatcggtaatactgggggcagggcctgcgcatgcagtatattttggtacatacgagttttgcaaagctcgcctgataagccctgaagatatgcaaactcatcaaccaatgaagaccgcactgagtggtaccattgctaccattgctgcggatgcattgatgaacccctttgacaccgttaaacaaagactacaattggatactaatctaagagtttggaatgttactaagcaaatatatcaaaatgaaggctttgcagcattttactactcctatcccacaacattggccatgaatatcccatttgcagcgttcaatttcatgatatatgaatctgccagcaaattcttcaacccacaaaattcctacaatccattgattcattgtctttgcggtgggataagtggtgcaacatgtgctgcgttaactacaccgttggattgcataaagactgtattacaggttagaggcagcgaaactgtctccatcgaaataatgaaggatgcgaacacttttggtagagcctcaagagccatactggaggttcatggttggaaggggttttggcgaggtttgaaaccaaggatagtggctaatataccagccactgccatttcttggactgcatatgaatgtgctaagcattttttaatgaaaaattga

SEQ ID NO: 819 - DNA, 945 bp, Saccharomyces cerevisiae
atggtagaaaactcgtcgagtaataattcaacaaggccaattccagcaatacctatggatctacccgattatgaggcgctccccacccacgcgccattgtaccatcaacttatagcgggtgcatttgctggtataatggaacattcagtgatgttcccgatagatgcccttaagacgcgaatacaatcagccaacgcgaaatcgctgtctgccaagaatatgctttcgcaaatatctcacatctctacttccgaaggaactctagccctatggaagggtgttcagtctgtcatactaggtgcgggacctgcgcatgcagtgtattttggtacgtatgagttctgcaaaaaaaatcttatcgattcgagtgatacgcaaacgcaccatccttttaagacagctatcagtggtgcctgtgccaccacggcatctgacgcattaatgaacccattcgacacaataaaacagagaatccaactcaatacctcggcatcagtatggcaaaccacaaagcagatttaccaatctgaaggtttggcagcattttattattcttacccaaccaccctagtaatgaacatcccatttgcagcatttaatttcgtcatatatgaatcatccacaaaatttttaaacccatcaaatgagtacaaccccctcatacattgtctgtgtggcagtatcagcggatcgacatgtgcggcgatcacaacacctttagactgcataaagacagtactgcagataaggggcagtcaaacagtttcgttggaaattatgagaaaggcggatacttttagtaaagcagccagtgccatatatcaagtttatggctggaaagggttttggagaggttggaaaccaaggatagtggcaaacatgccggctactgctatatcatggacagcttatgaatgtgcaaaacatttcctaatgacgtattag

SEQ ID NO: 820 - DNA, 459 bp, Saccharomyces cerevisiae
atgtccttcattaaaaacttgttatttggaggtgttaaaacaagtgaggatccaaccgggctcacaggtaacggggcctcaaacacaaacgattctaataaaggtagtgaaccggtagtagcgggtaatttctttcctaggacgctttccaaatttaacggccacgacgatgaaaaaatatttattgctattaggggcaaagtatacgactgcacaagagggaggcagttttacggtccaagcgggccatacactaactttgcaggccatgatgcgtcgcgtggtcttgcattgaactccttcgatctggacgttattaaagattgggatcagcctatcgatcccttagatgatctgacaaaagaacagattgacgcactggatgagtggcaagagcattttgagaataagtacccatgcattggtactctgattccggagcctggcgtgaacgtatga

SEQ ID NO: 821 - DNA, 1683 bp, Saccharomyces cerevisiae
atgaattggtcttttctactacagctggtaataacaatattgttaattgtgctgggcgccaactggttgctaagctcttttctacttgattttaagagagatttaacaggggtggctttgtcacagcaatctagcatatccagtgttcgtaaagaaaatgaaacagcatattatcgaagcattttagtgcccacaggattcccattgacgacaggattagggctatctttaaaatacaaaataagaaatggcaatttcggtgatgtttggaatgccataatggaagtttccaagggaaaaaacataattaaatttacaggaagagaaaaaagttattcgttgagtgaacttaatggtatggccaagcgcatatttccgaaactttccaataagaatttcaaaaatatcggtatagctaattctattgctaccgtagagggttttactctctccttggcttccatgatgacctctataagaacaggttcaatacctcatttcttgccagctgttcctagacaacgactagaagatgttgatgtcctgatcatcgactcatggaagtcttttaagatgctaaacggcagcgaggattggtacaagcttattgttgtttgcgatgatcctatcgaatcactacaatttgatgcgaactgtgatgttatcacttggaaagaacttatcgacggttttaccaaggatacagagtaccaatacaccccgccagatgacaactctgatgataagaaactttttgcatacgtaacttcaccatggaatggaactaatagttttaatcaaatctgtctggtgagtaatatagcggaattcatcaaagggttccccttgggaaatgaattgaatagtaatgaatacctaaccatttcgacaaaattggcaaattctagtgcaagcctacaaatttggggaaagctttttgcagttttgctgcatggtgggtctgcatctttcatcaatcctacaacgatagattgcgagtcgttgcaagaaactacgttactgtttaccgaaacaaaggatgttgtcaaattaattgattctaattctagaagtgggctgctgaataaaatctacttatcctgggccacgaacttactgagcgagggtatttttacgaaaattgccagaatcgagccacattctcttgaaaaattaagatgtgtttatttggcagataatgtgaaagatgctgaggttatttcgacatttcctgaaaaaattcctcagctaaaaaagactaaccgaagaatcaccccaagcactgaacaattgaataaaataagagctcaattaggatcccgtgtagtcctcgagttatattgtccctacgctatcatgggacctgtggcacataccaatttttatgactatagggtttttggaaaatctgtggacgataacgttgtatgttatggaacactaagtacaacattagaaggaaaaatggtagaaacggaaacaaaccctcatttgaacatagagaagaagcagggtatgttatgtattcgtggttttagcataggtaaaccagtagagtccgatcgtttagagaaagctttgcatttagctgaaaggtttggaggaggtgaaggatggatgcctctagttggcgtttttggactatttggccaagacggttgcttatacatctataatcaatga

SEQ ID NO: 822 - DNA, 1782 bp, Saccharomyces cerevisiae
atgacaatttcgaataaatcgtggaggagctacttcccacatttgagaaaactacccgaagatgatcagtacttatactcagacgatactaactccagtatcatagctgaagaggagctacatcatagcgtagataagtcctcgaagacagacgttacggcagaaactacagctgtagaacctcatcctcacaatttaaggcatgacttgccatatgaagtgagagatgaagctgggcgtaaatggtggaaatattttgatgaattcgagtatcgtgttaataaggaatacaagaaatcacgtaagtggtacgagtttttgtatcctaatcatactactcaaaccaaggctgaaagacggcttctttacaagctagacattattattgctttatacttttttatgttatgttggtccaagtcagtggatttgaataactacactaacgcatatgtttccaatatgaaggaagatttaaacatgaaaggtaatgattacgtttacacttctactattgctaatgttggtgccattgtcttccaattaccatttatgtatttgttaccaagatttccctctcatattattttgcctgtaatggacttgggctggacttggttcacatttgcatgttatagggcaaactcactagccgaactaagggcttacagatttattttaagtgcctttggcgctgcttactacccagtgtcccaatatatactaggttgttggtatgccccagatgaaattaattcaagagtctgtttattcttttgtgggcaacaattgggttccgtgacttcaggacttctgcaaagtcgcatattcaaaagtttgaacggcgtccatggtctagcaggctggagatggatgtttctgatcgatgccattgcaatttctcttcccacggctattattggtttttttgttattcccggtgtaccatctaagtgttactctttatttctgactgacgaagaaatacgaattgcaagggccagaaataagaggaaccaaatcaaagatggtgttgataaaagtaagctagccccattatggagcagaaaactttggaagaaagtattttgtactccagcattctgggtacttgttgtttttgatacatgttcgtggaataacatgactgcgtatagtggttcatatactttgtggttaaagtctaatacaaagtactccattgcccaagtgaacaacctgagtgttatacccgcatgtttaggatttgcgtatgtgattttttgtgcctttggtgccgatttatttagatgtaagtggatattcatggtttttgctgctataatgaataccgtttcttgtgccttacttatcaagtgggatattccttcgaaagctaaatggtacgctttcttcaccacgtatttcagtgtggccgcatcgccttgtctatggtcgtttattaatgacttcttaaggtttgatcctcaggtgaaggctattacatggatcgccatttattccttctctcaatccacttacgcctggattcctaccttggcgtggcctaccgtggagtcaccacgttttaagactggttacaccgtgagcttaatttttggtgctatttacggtttatggacgtttgttgtactttttttttacaagagaaacgaaaagaaacatgctctaggtaatggtatcatcttgtatgatagtaataagggtgaagagcttccagaatttgtaaagaaaaatatggaggaaagagatggttactactatttaaagcggtcctcgtag

SEQ ID NO: 823 - DNA, 954 bp, Saccharomyces cerevisiae
atggaggacagtagcaatacaatcataccctcacccactgacgtgggggcgctagcaaacagaatcaactttcaaaccagagatgcccacaataaaatcaataccttcatgggcataaagatggccatcgccatgagacatggctttatatacagacagggtattctggcgtactattatgtgttcgatgccatcgagcaagagatagatcgcctactgaatgaccccgtaacggaggaggagctgcaaacttcgaccattctgaagcagttttggctcgaagattttagaagatctacgcagatctataaggacctgaagctgctatactcaaacacgtttaaaagcacagaatcattaaacgaattcctggctacgttccagaagccaccgctactacagcagtttatcaataacatccacgaaaacatacacaaggagccatgcaccattctttcttactgtcacgttctgtacttggcgcttttcgccggcggcaagctaatacgatcgaatttgtacagaagactggggctcttccccaacttcgagaagctatcacagaaggaactggtcaaaaagggcacaaacttcttcaccttcagcgatctgggtcccactgaagaaacacgcttgaaatgggaatacaagaagaactatgagctggccaccaggacggaattgaccgaagcacaaaagttgcagatcattagcgtcgcagaaggcatttttgattggaacttcaacatcgttgcagaaattggagagttgaatcgtcgcgagttaatgggcaagttcagcttcaagtgtattacgtacttgtacgaagaatggatgttcaacaaggattctgctactagaagagcactccacacggtcatgctgctggtgctttctattatcgcgatctgggttctttacttcttggtaaagagttttcttagcatagtataa

SEQ ID NO: 824 - DNA, 858 bp, Saccharomyces cerevisiae
atgtgggctcaattatcatatactagaccagaatctcagaagactgacttaacgtcgttgttttccacagatcaagagcaaaatccattaaatgactaccagtaccagatcaatattagggaactggaggagtattacaacaagacgattttaaacgaggataacatacaggaaacaagcagtgaaatatcttcggcagtttcattctctccaccaaaaaatacaaacgctattcaaccggggctactgtatgatccacagttaatgaacccttttctcccatccgctcacctgaatagcacggcacctactacttttaaaaagaaactagaggtacaaataaatccggactatgtcccaaaatcttcacaattaccattaacttcacagaatttgcaacagttgtctcaacaaaagcccaaaaatgatgcttctttttcatcagagaaggaatcctcagctcaacctaaggtgaaaagccaagtgcaggaaactcccaaacaattatacaagacagagctgtgcgaatcattcactttaaaaggaagttgcccttatggcagtaagtgtcagtttgctcacggactcggcgaattaaaggttaagaaatcgtgcaagaatttcaggacgaagccctgtgtgaattgggagaaactaggttattgtccttatggcagaagatgctgcttcaaacatggcgacgacaacgacattgctgtttacgtgaaagctggtacttactgtaacgtctcttcgactagcaaacaatcagacgaaaagagaagcaatggtcgcggctccgccaagaagaagaatctaaatgttaaagtaaaggctttgcagagaatgacctggtga

SEQ ID NO: 825 - DNA, 978 bp, Saccharomyces cerevisiae
atgatgccgaatgttgctccaaacagctactatttaaacataccgaatgccaattcgacctcaacgactacgtcctcgatcttttctgatctcaacaaggagtacgagtcaaagattaaagaaatcgaagaatattatataaagacactgctcaatgaaaataccgataatgatgacagcagcagctccgaggggcataatataaatgaaacggacattttaagtgaatactcaccaaggccttctccttggttaccatccaaaccaaactgttatcatccgttgggagattttaaagacttgatcatatcagattccagacctacaaatacattacctattaataaccctttcgcaggcaataataacatctcaacacttgctacaactgagaaaaaacgtaagaaaaggtcactcgaagttgagattaaccctacttacacgacaagtgcattttcattacccctgacagcggagaatttacaaaaactatctcaggtggattctcagtctactggacttccatacacacttccaattcagaaaacaacaaaactggaaccttgtagaagggcacctttgcagcttcctcaattagtcaataagaccttatacaaaactgagctctgtgaatcttttactattaaaggctattgtaagtatggaaataaatgccaatttgctcatggtcttaatgaactgaaattcaagaaaaaatcaaacaattatagaactaaaccttgcataaattggtcgaagttaggctactgtccgtacggtaagcgttgctgtttcaaacacggtgatgataaggacgttgaaatatatcaaaatgctaacgatggaagaagtaaggatacggcgttgactccacttcctacttccctagccccaagcaacaacgataatatcactaatttgagtaagcctaggaacttacatactagtgttaaagcattgcaaaggatgacttggtag

SEQ ID NO: 826 - DNA, 525 bp, Saccharomyces cerevisiae
atgattaagcggtctctcgcaagtttagttcgagtcagctctgtaatgggcagaagatatatgatagcagcggcaggaggagaacgtgccagattttgtccagctgtaacaaataaaaagaatcatactgtaaatacttttcagaagagatttgtagaatcctcgacagatggtcaagttgtgcctcaagaagtgttaaacttaccgcttgaaaaataccatgaagaggcagatgactacctagaccatttactagatagcttagaagaactgagtgaggctcatccggattgtatacctgatgtagagctaagccatggcgtaatgacattggaaattccagcttttggaacgtatgtaataaacaaacagcctccaaataagcaaatttggttggcatcaccattgtccgggcctaacagatttgaccttctcaatggggagtgggtttcgttaagaaatggcacaaagctaacagatatacttactgaagaagttgagaaggccatttctaaaagccaataa

SEQ ID NO: 827 - DNA, 1974 bp, Saccharomyces cerevisiae
atgcttaaatctggtagactcaactttctcaagttgaatatcaattcacgattactatactcaacgaaccctcaactgactaagaaggtcattggtatcgacctgggtaccacgaatagtgctgttgcatatatccgtgattctaacgacaaaaaatcagctacaatcatagaaaatgatgaaggacaacgaaccacaccatctatagttgcctttgatgtcaaaagctcgccacagaataaagatcaaatgaaaactcttgtagggatggcagctaaaaggcaaaatgctattaattctgaaaacactttctttgctacaaagagacttattggccgtgcattcaacgacaaggaagttcagcgagatatggctgttatgccatataagattgtcaaatgtgagtcaaatgggcaagcctatctcagcacgtctaatggtctcattcaatcaccaagccagatagcatctatattactgaaatacctgaaacaaacttcagaagaatacttaggcgaaaaggttaatttggcagttattacagttccagcatattttaatgattctcaaaggcaagccacaaaagatgccggcaagttagctggcctaaatgttttgagagttattaacgaaccaactgcggccgccttaagctttggaattgatgataagaggaataatggattaattgcagtttacgatttgggtggtggtacatttgacatatccatcttggacattgaagatggcgtgtttgaggttcgtgctactaatggtgacacgcatttaggtggagaagattttgacaacgtcattgtaaactatattatagataccttcattcatgaaaaccctgaaattacacgggaagaaattacgaagaacagggagacaatgcaaaggttaaaagatgtttctgaaagagctaagatagatttatcccatgtgaagaaaacttttatcgaacttccatttgtatacaaaagcaaacatctacgagtgccaatgacagaggaagagctggataatatgactttgtcattaatcaacaggactatcccacctgtgaagcaagcattgaaagatgccgatatcgaaccggaggatatagatgaagtaatccttgttggtggtatgacccgtatgccaaagattagatctgttgtaaaagatctttttggtaagtctccaaattctagtgttaacccagatgaaacagttgctttaggagcagctattcaaggtggtattctatccggtgaaataaagaatgtcttacttttggatgtgacaccattgacattagggattgaaacatttggaggagcgttctcacccttgatacctagaaatacgacagttccagtaaaaaaaacagagatatttagtactggtgttgatgggcaagcgggtgttgatatcaaagtttttcagggtgaaagagggttagtgcgtaacaacaagttgattggtgatttgaaacttacaggaatcacccctttgcctaaaggcattccccaaatatatgttacttttgatatcgatgcggatggtatcatcaacgtatctgccgctgagaaaagtagtgggaaacaacaatccattactgtaataccaaattctgggttaagcgaagaggaaattgcaaaacttattgaagaagcaaatgcaaatagggcacaagataacttgatcaggcaaaggttagagcttatctctaaggctgacattatgataagtgatactgagaatttatttaaaagatatgaaaaactgatttctagcgaaaaagagtattctaatatcgtagaggacatcaaagctctgagacaagctataaagaattttaaggctaacgaaaatgacatgtcaattgatgtaaacggaataaaaaaagctacggatgcgctacagggtagggcattaaaattattccaaagcgcaacaaaaaaccagcagaatcaaggtaaataa

SEQ ID NO: 828 - DNA, 498 bp, Saccharomyces cerevisiae
atgcttcctgttataacgagatttgcaaggcctgctctgatggccatcagacctgtgaatgccatgggggttttgagagcgtccagcataacgaaaaggctttatcatcccaaggtcatagagcattatacacatccaagaaacgtcggctcattagataaaaaattgcccaacgtcggcactggtctagtgggtgcgccagcgtgcggtgatgtgatgaggttgcagatcaaagtcaacgactctactggcgttattgaagatgtcaaattcaaaacttttggatgtggctccgccattgcctcctcttcatatatgactgaattggtacaggggatgaccttggacgatgcggcaaaaattaagaacactgaaattgctaaggagttgagcttgcccccagtcaagttgcattgctctatgttagcggaagatgcgatcaaggcagctattaaggactacaaatctaagagaaacactccaaccatgttatcgtaa

SEQ ID NO: 829 - DNA, 471 bp, Saccharomyces cerevisiae
atgttcgccagactcgctaatcctgcccacttcaagcctctcacgggctcccacataacaagagctgccaaaagactttaccatcctaaggtaattgaccactacacaaacccaagaaacgttgggtccatggataagtccttagctaatgtcggcacaggaatcgtgggcgcccctgcgtgtggtgatgtgataaaactacaaatacaggtgaatgataaatcgggtattatcgagaacgttaagttcaagaccttcgggtgtgggtctgccatcgcttcctcctcctacatgaccgagctggtacgcggtatgtcacttgatgaggccgttaaaattaaaaacacggaaatcgcgaaggagctaagtcttcctccagtaaaactgcattgttccatgcttgcagaagacgctatcaaggcggcaatcaaggactacaaaacaaagaggaacccctccgttttgcattga

SEQ ID NO: 830 - DNA, 2073 bp, Saccharomyces cerevisiae
atgctgcttcttccaagatgtcctgtaattgggcgaattgtaagatcaaaatttagatctggtctaatccggaaccattcgcccgttatatttactgtgtctaagttatcaacccagcggcctctgttattcaattcagctgtgaatttatggaatcaagcacaaaaggatattacgcacaaaaaatccgtcgagcaattctcgtcggctccaaaagtgaagactcaggtaaaaaagaccagcaaggccccaaccctctcggaactgaaaatcttgaaagatctatttcgctatatttggcccaaaggcaacaataaagtgaggataagggtactgattgcccttggactgttgatatccgccaaaattttaaatgttcaagtacctttttttttcaagcaaactattgattcaatgaatatagcatgggatgatcctacagtcgcccttccggcagcgattggattaaccattctttgctatggtgttgcaaggttcggctctgttttattcggcgaactgaggaacgccgtatttgccaaagtggcacagaatgccattagaactgtgtcgctacaaactttccagcaccttatgaagttagatttgggatggcacttgagtagacaaacgggtggtctgacgagggccatggatagaggtacaaagggtatatctcaagtgttaacggccatggtattccacattatccctataagttttgaaatatctgtcgtttgtgggattttgacgtatcaattcggtgcgtcatttgccgcaataacattcagtacaatgcttttatactccattttcactataaagacgaccgcatggaggacacattttagaagggatgctaacaaggccgataacaaagctgccagtgtggctttagattctttaattaattttgaggcggtaaaatacttcaacaatgaaaaatatcttgcagataagtataatggctccttgatgaactatcgtgactctcaaattaaagtatcgcaatctctagcatttttgaactccggccaaaatctaatttttactactgccctaactgcaatgatgtatatgggttgcaccggcgttattggtggcaacttgacagttggtgacttggttctaattaatcagttggtttttcaactatcagtaccgctaaattttcttggtagtgtttacagagatttaaagcagtctctgattgatatggaaacgctatttaagttaagaaaaaatgaagtcaagattaaaaatgccgaacgtcccttaatgcttccagaaaatgttccctacgatattacttttgagaacgtcacgtttggatatcatcccgataggaaaattttaaagaatgccagctttaccatcccagcaggctggaaaaccgcaatagttgggtcttcgggcagtgggaagtccaccattttaaaattagtctttagattttatgatcctgaaagcggaaggatcctcataaacggtagagatattaaagaatatgacatcgatgccttgaggaaggtgattggtgtggtaccacaggacacaccacttttcaatgacactatctgggaaaatgtaaagttcggtcgtattgacgcaaccgacgaggaagtgataactgtagttgaaaaagcccagctagcacccttaatcaagaaattaccacaaggttttgacaccatcgtcggggagcgagggttgatgatcagcggtggtgaaaagcaaaggctggcaattgcaagggtactattgaagaatgcaaggatcatgttttttgacgaggccacaagcgccttggacacacacacagaacaagctctcttacgaaccattagagataactttacttcgggttcgagaacgagtgtatacatcgcacatagactgaggacaattgcagatgcagacaagatcatagtccttgacaacggaagagtaagagaggaaggtaagcatcttgaactgttggctatgccagggtcattgtaccgcgaactttggaccatacaagaagatctggatcatttagagaatgaactaaaagaccagcaagaactatga

SEQ ID NO: 831 - DNA, 453 bp, Saccharomyces cerevisiae
atgtttctcccaaaattcaatcccataaggtcattttcccccatcctccgggctaagactcttcttcgttaccaaaatcggatgtatttgagcacagagataagaaaagctattgaagatgccatcgaatcggctccagtggttcttttcatgaaaggtactcctgaatttcccaagtgtggattttcaagagcaaccattggattattaggaaatcaaggcgttgacccggccaaatttgcggcttataatgttttagaagacccagagctacgtgaaggtatcaaagagttttcagaatggccaactattccacagttatatgtaaacaaagaattcattggtggatgtgatgttattacaagtatggcacgctctggtgaattggccgatttgctagaagaggcacaggcattggtacctgaagaagaagaagaaaccaaagatcgttga

SEQ ID NO: 832 - DNA, 432 bp, Saccharomyces cerevisiae
atggagaccaatttttccttcgactcgaatttaattgttattatcattatcacgttgtttgccacaagaattattgctaaaagatttttatctactccaaaaatggtatcccaggaaacagttgctcacgtaaaggatctgattggccaaaaggaagtgtttgttgcagcaaagacatactgcccttactgtaaagctactttgtctaccctcttccaagaattgaacgttcccaaatccaaggcccttgtgttggaattagatgaaatgagcaatggctcagagattcaagacgctttagaagaaatctcgggccaaaaaactgtacctaacgtatacatcaatggcaagcacattggtggtaacagcgatttggaaactttgaagaaaaatggcaagttagctgaaatattgaagccggtatttcaatag

SEQ ID NO: 833 - DNA, 1476 bp, Saccharomyces cerevisiae
atgagtgctctactgtccgagtctgacctaaacgattttatcagtcccgcccttgcgtgcgtcaaacctacccaggtgagcgggggcaagaaggataacgttaacatgaacggagaatacgaggtgagcacggaaccagaccaactggagaaggtctctattaccctatcagactgcctcgcgtgttctggttgtataacgtctagtgaagaaatcttgttgagtagccaaagtcactcggttttcctgaaaaactgggggaagctttcgcagcagcaagacaaattcctcgttgtgagtgtctcgccacaatgcagactatctcttgcgcagtactacggcttaacattggaggcggccgatttgtgtttgatgaattttttccaaaagcatttccagtgcaagtatatggttggaacggagatgggcagaatcatatcgattagcaaaaccgtagagaagatcattgcgcataagaaacaaaaagaaaataccggtgcggaccgcaagcctctattatctgctgtgtgtccgggatttcttatatacacggaaaagaccaaaccgcagttggtgcctatgctgctcaatgtcaagtcgcctcagcaaattacgggctcgttgatcagagctacgttcgagagtctcgctatcgcgcgtgagtccttttaccatctgtcgctgatgccatgttttgacaagaaactagaagcgtcaaggccagaatcgcttgacgatgggattgactgtgtcattacgccacgtgaaatagtgacaatgttacaagagttgaatttagacttcaagtcgtttcttactgaggacacaagtttatatgggcggctatcaccgccgggatgggacccgcgagtccactgggcgtcgaatctgggaggcacttgtggtggctatgcctaccagtacgtaacggctgtccaacgactacacccaggaagtcagatgatagttctggagggtagaaacagcgacattgtcgagtaccgattgctgcacgatgatcgcataatagccgccgccagcgagctttccgggtttagaaacatccaaaatctggtgcgtaaactgacctcgggctccgggtcagagcgcaagaggaacatcaccgctctgcggaagagacgaacaggtccaaaggcgaactcacgcgagatggcggccgccacggccgccacggccgatccctaccactcggactacatcgaggtaaacgcgtgtccgggtgcatgcatgaacggtggtggcctactcaatggcgagcaaaacagtctcaagcggaagcagttggttcagacactgaataagcgtcacggagaggagctagcaatggtagatcctctaaccctgggacccaagctagaagaggcggcagcccgcccgctttcgctagagtacgtcttcgcgcccgtcaagcaggccgtcgaaaaggatctcgtctctgttgggagcacctggtaa

SEQ ID NO: 834 - DNA, 882 bp, Saccharomyces cerevisiae
atggaggaacaggagataggcgttcctgcggcctctttggcaggaataaaacatatcatattgatcctttccggaaaaggtggtgtcggtaaaagttcggtaacgacacagactgcgctgactctttgcagtatgggcttcaaagttggagttttagatattgatttaacagggccatccttaccgaggatgtttggcctagagaacgaatctatatatcaaggtcctgaaggttggcaacctgtgaaagtggagacaaactctactggctctcttagtgtaatatcattggggtttctactaggtgatagagggaacagcgtgatatggaggggtcctaagaagacttctatgataaaacaattcatctctgacgtcgcctggggtgaactggattacttactgatcgatacccctccgggaacgtcggatgaacatatatcgattgcagaggagctgagatattccaaaccagatggtggtattgtagtaactaccccacagagtgttgcaacagctgatgtcaaaaaagaaatcaatttctgcaagaaggtcgatttaaagatcctcggtataattgaaaacatgtcagggtttgtatgcccgcattgtgctgagtgtacaaatatcttttccagtgggggtggtaaaagattatcggagcaattttctgtcccataccttggtaacgttcctatagatccaaaatttgtagaaatgattgagaatcaagtttcaagtaaaaaaacgcttgtagaaatgtacagagaatcatctctttgtcccatttttgaagaaataatgaagaaactgaggaaacaagacactacaacccctgttgtggataaacacgagcaaccccagatagaatctccaaaataa

SEQ ID NO: 835 - DNA, 987 bp, Saccharomyces cerevisiae
atgactgagatactaccacatgtaaacgacgaagtgctaccagcagagtatgaacttaatcagccggaaccagaacactgtcctggtccagaatcagacatggcaggtaagtccgatgcttgtggtggctgcgccaataaagaaatatgtgaaagtcttccgaaaggccctgatccagatattccattgatcacagataacttgtcaggaatagaacataaaatattggttttatcaggcaaaggtggcgtaggcaagtcgacatttgccgcaatgctaagttgggcactttcagctgacgaagatttacaagtaggtgccatggatttagatatatgtggaccttctttgccacatatgttaggctgcattaaagaaaccgtccatgaatcgaactccggttggacacctgtctatgtgactgataatttagccaccatgtctattcaatatatgcttccagaagacgattccgccattatatggaggggttcaaaaaagaatttattgataaaaaaatttttaaaggatgttgattgggataaactcgattacttggtaatcgacacaccgcccggaacatctgatgagcacatttcaataaacaagtatatgagagaatctggcatagatggtgcccttgtggtcaccacacctcaggaagtagctttattagatgtacggaaagagatagatttctgtaagaaggctggtatcaatattcttggactagtggaaaatatgagcggatttgtatgtccaaattgcaaaggagagtcccaaatattcaaggctaccacaggtggaggtgaagcactttgtaaggaattgggcatcaaatttttggggtctgttccgttagatccgaggattggcaagagttgtgacatgggtgaaagtttcctggataactatcctgacagcccagcttcgagtgctgtacttaacgttgtggaggctctgcgagatgctgtgggggatgtatag

SEQ ID NO: 836 - DNA, 993 bp, Saccharomyces cerevisiae
atggcgtctatcaatctgattaagtctttgaaactttacaaggaaaagatatggtcttttgacttttctcaaggtatattagcaacaggttcaactgatcgaaaaattaagctagttagcgtgaaatatgacgattttacgttaattgatgtgctagatgagactgctcataaaaaggcgattcgatctgtggcgtggagacctcacacttcgctgttagcggctggctcttttgattccactgtatctatctgggctaaggaagaatctgctgacagaactttcgagatggacctgctagctattatcgaaggtcacgaaaatgaagtaaaaggtgtagcgtggtcgaatgatggatattacctagcaacctgttccagagataaaagcgtgtggatatgggaaacagatgaaagtggcgaggaatatgagtgtattagtgttttgcaagaacattcacaagacgttaaacatgttatatggcatccatctgaagcattactggcttcaagttcttatgatgacaccgtcaggatatggaaagactatgacgatgactgggaatgtgttgctgtcttaaatggccatgaaggaactgtttggtcttctgattttgacaagactgagggcgtgtttagactgtgcagtggaagcgacgattccactgtacgggtatggaaatacatgggtgacgacgaggatgatcaacaagaatgggtttgtgaagctattctcccggatgtacacaaaagacaggtatacaatgttgcatggggctttaatggcctcattgctagtgtaggagcggatggagtactagcggtctatgaagaagtagacggagaatggaaagtttttgctaaacgtgcattatgtcatggagtttatgaaatcaacgttgtgaagtggttggagttaaatggtaaaactatacttgcaacaggcggtgacgacgggatcgtaaatttctggtctctagaaaaagcagcgtag

SEQ ID NO: 837 - protein, 493 aa, Saccharomyces cerevisiae
MSFVQIRHISSQINRKTVSIVGSGPSGFYTAYHLLKKSPIPLNVTIWEKLPVPFGLSRYGVAPDHPEVKNCEETFTTCAEEFSSPTNQKHKFSFVGGITIGKEILLKELLDNQDAVILSYGCTGDRKLNIPGELGTKGVFSSREFVNWYNGHPDFAKDKRFTDFDWSKVSKVGIIGNGNVALDITRVLISNQIDEIWENTDISSLALNLLRRAPVKDVKLIARRDFVHSKFTNKELRELWELEKYGIRGRIDPKFFQKEMFDPSKYDRAFNRRVEMCSEYLKPFNERSKKNYKKAPPPSSGYDKFWELDYLKTPLKINRDDFGAINSLSLCNNRLNEDNSLQPLKDVNNIMTYKVDLLITSLGYAGVPMPEFSKLSIGFDKDHIANKQGRVLTSSGEIFPHLYASGWIRKGSQGVIASTMQDAFEVGDRVIQDLVVSGALSLENSIDLSNIKHTTWKDWERINKKELLRGKKEHKTRSKFLTFEELWNGVEGI

SEQ ID NO: 838 - protein, 189 aa, Saccharomyces cerevisiae
MKAIDKMTDNPPQEGLSGRKIIYDEDGKPCRSCNTLLDFQYVTGKISNGLKNLSSNGKLAGTGALTGEASELMPGSRTYRKVDPPDVEQLGRSSWTLLHSVAASYPAQPTDQQKGEMKQFLNIFSHIYPCNWCAKDFEKYIRENAPQVESREELGRWMCEAHNKVNKKLRKPKFDCNFWEKRWKDGWDE

SEQ ID NO: 839 - protein, 300 aa, Saccharomyces cerevisiae
MPHTDKKQSGLARLLGSASAGIMEIAVFHPVDTISKRLMSNHTKITSGQELNRVIFRDHFSEPLGKRLFTLFPGLGYAASYKVLQRVYKYGGQPFANEFLNKHYKKDFDNLFGEKTGKAMRSAAAGSLIGIGEIVLLPLDVLKIKRQTNPESFKGRGFIKILRDEGLFNLYRGWGWTAARNAPGSFALFGGNAFAKEYILGLKDYSQATWSQNFISSIVGACSSLIVSAPLDVIKTRIQNRNFDNPESGLRIVKNTLKNEGVTAFFKGLTPKLLTTGPKLVFSFALAQSLIPRFDNLLSK

SEQ ID NO: 840 - protein, 110 aa, Saccharomyces cerevisiae
MVSQETIKHVKDLIAENEIFVASKTYCPYCHAALNTLFEKLKVPRSKVLVLQLNDMKEGADIQAALYEINGQRTVPNIYINGKHIGGNDDLQELRETGELEELLEPILAN

SEQ ID NO: 841 - protein, 497 aa, Saccharomyces cerevisiae
MFISRRCRIKGFTLKNLLWFRSSSTRFVSTESPDASAITKPDGIFNYSLLENRTYIRIRGPDTVKFLNGLVTSKLLPHFIKKNLTTVEENEVPTEEGTTKVDPIIPVPEFDARLGNWGLYNEKGIQGPYISRFGLYSAFLNGKGKLITDTIIYPTPVTVSEQISNYPEYLLELHGNVVDKILHVLQTHKLANKIKFEKIDHSSLKTWDVEVQFPNLPKDIENPWFDNLLDPMALPKNSIDANNFAVNVLNSLFNSDPRILGIYVERRTESMSRHYSTFPQSFRVVTSEQVDDLSKLFNFNVFDFPFQVNKKASVQVREIRFQKGLIDSTEDYISETLLPLELNFDFFPNTISTNKGCYVGQELTARTYATGILRKRLVPVKLDNYQLLDTDPERKYAEFHIDNVVEKSLAENEPTLNPFTNKPPERTKRKQRPAGLLISNEGLYGVALLRTEHFSAAFSSDEPVEFYITTTKGENIKITPQKPFWFSDWKNNNGPHK

SEQ ID NO: 842 - protein, 250 aa, Saccharomyces cerevisiae
MINTGRSRNSVLLAHRFLSTGGFWRGGTNGTMSRTINNVNPFKLKFIPKTVPAAADSVSPDSQRPGKKPFKFIVSNQSKSSKASKSPKWSSYAFPSRETIKSHEEAIKKQNKAIDEQIAAAVSKNDCSCTEPPKKRKRKLRPRKALITLSPKAIKHLRALLAQPEPKLIRVSARNRGCSGLTYDLQYITEPGKFDEVVEQDGVKIVIDSKALFSIIGSEMDWIDDKLASKFVFKNPNSKGTCGCGESFMV

SEQ ID NO: 843 - protein, 185 aa, Saccharomyces cerevisiae
MQAKLLFTRLNFRRPSTTLRQFPLTCFLFHSKAFYSDLVTKEPLITPKRIINKTPGLNLSISERASNRLAEIYRNSKENLRISVESGGCHGFQYNLTLEPATKPDIKNDVKDKEFSDDLDDDDSKDIIYVLPEDKGRVIIDSKSLNILNNTTLTYTNELIGSSFKIINGSLKSSCGCGSSFDIEN

SEQ ID NO: 844 - protein, 184 aa, Saccharomyces cerevisiae
MLKYLVQRRFTSTFYELFPKTFPKKLPIWTIDQSRLRKEYRQLQAQHHPDMAQQGSEQSSTLNQAYHTLKDPLRRSQYMLKLLRNIDLTQEQTSNEVTTSDPQLLLKVLDIHDELSQMDDEAGVKLLEKQNKERIQDIEAQLGQCYNDKDYAAAVKLTVELKYWYNLAKAFKDWAPGKQLEMNH

SEQ ID NO: 845 - protein, 228 aa, Saccharomyces cerevisiae
MRAFSAATVRATTRKSFIPMAPRTPFVTPSFTKNVGSMRRMRFYSDEAKSEESKENNEDLTEEQSEIKKLESQLSAKTKEASELKDRLLRSVADFRNLQQVTKKDIQKAKDFALQKFAKDLLESVDNFGHALNAFKEEDLQKSKEISDLYTGVRMTRDVFENTLRKHGIEKLDPLGEPFDPNKHEATFELPQPDKEPGTVFHVQQLGFTLNDRVIRPAKVGIVKGEEN

SEQ ID NO: 846 - protein, 497 aa, Saccharomyces cerevisiae
MLKSTATRSITRLSQVYNVPAATYRACLVSRRFYSPPAAGVKLDDNFSLETHTDIQAAAKAQASARASASGTTPDAVVASGSTAMSHAYQENTGFGTRPIYLDMQATTPTDPRVLDTMLKFYTGLYGNPHSNTHSYGWETNTAVENARAHVAKMINADPKEIIFTSGATESNNMVLKGVPRFYKKTKKHIITTRTEHKCVLEAARAMMKEGFEVTFLNVDDQGLIDLKELEDAIRPDTCLVSVMAVNNEIGVIQPIKEIGAICRKNKIYFHTDAAQAYGKIHIDVNEMNIDLLSISSHKIYGPKGIGAIYVRRRPRVRLEPLLSGGGQERGLRSGTLAPPLVAGFGEAARLMKKEFDNDQAHIKRLSDKLVKGLLSAEHTTLNGSPDHRYPGCVNVSFAYVEGESLLMALRDIALSSGSACTSASLEPSYVLHALGKDDALAHSSIRFGIGRFSTEEEVDYVVKAVSDRVKFLRELSPLWEMVQEGIDLNSIKWSGH

SEQ ID NO: 847 - protein, 256 aa, Saccharomyces cerevisiae
MFKSVAKLGKSPIFYLNSQRLIHIKTLTTPNENALKFLSTDGEMLQTRGSKSIVIKNTDENLINHSKLAQQIFLQCPGVESLMIGDDFLTINKDRMVHWNSIKPEIIDLLTKQLAYGEDVISKEFHAVQEEEGEGGYKINMPKFELTEEDEEVSELIEELIDTRIRPAILEDGGDIDYRGWDPKTGTVYLRLQGACTSCSSSEVTLKYGIESMLKHYVDEVKEVIQIMDPEQEIALKEFDKLEKKLESSKNTSHEK

SEQ ID NO: 848 - protein, 633 aa, Saccharomyces cerevisiae
MSSNNNTNTAPANANSSHHHHHHHHHHHHHGHGGSNSTLNNPKSSLADGAHIGNYQIVKTLGEGSFGKVKLAYHTTTGQKVALKIINKKVLAKSDMQGRIEREISYLRLLRHPHIIKLYDVIKSKDEIIMVIEYAGNELFDYIVQRDKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGAAGLIKRMLIVNPLNRISIHEIMQDDWFKVDLPEYLLPPDLKPHPEEENENNDSKKDGSSPDNDEIDDNLVNILSSTMGYEKDEIYESLESSEDTPAFNEIRDAYMLIKENKSLIKDMKANKSVSDELDTFLSQSPPTFQQQSKSHQKSQVDHETAKQHARRMASAITQQRTYHQSPFMDQYKEEDSTVSILPTSLPQIHRANMLAQGSPAASKISPLVTKKSKTRWHFGIRSRSYPLDVMGEIYIALKNLGAEWAKPSEEDLWTIKLRWKYDIGNKTNTNEKIPDLMKMVIQLFQIETNNYLVDFKFDGWESSYGDDTTVSNISEDEMSTFSAYPFLHLTTKLIMELAVNSQSN

SEQ ID NO: 849 - protein, 1703 aa, Saccharomyces cerevisiae
MNIPQRQFSNEEVNRCYLRWQHLRNEHGMNAPSVPEFIYLTKVLQFAAKQRQELQMQRQQQGISGSQQNIVPNSSDQAELPNNASSHISASASPHLAPNMQLNGNETFSTSAHQSPIMQTQMPLNSNGGNNMLPQRQSSVGSLNATNFSPTPANNGENAAEKPDNSNHNNLNLNNSELQPQNRSLQEHNIQDSNVMPGSQINSPMPQQAQMQQAQFQAQQAQQAQQAQQAQQAQARLQQGRRLPMTMFTAEQSELLKAQITSLKCLVNRKPIPFEFQAVIQKSINHPPDFKRMLLSLSEFARRRQPTDQNNQSNLNGGNNTQQPGTNSHYNNTNTDNVSGLTRNAPLDSKDENFASVSPAGPSSVHNAKNGTLDKNSQTVSGTPITQTESKKEENETISNVAKTAPNSNKTHTEQNNPPKPQKPVPLNVLQDQYKEGIKVVDIDDPDMMVDSFTMPNISHSNIDYQTLLANSDHAKFTIEPGVLPVGIDTHTATDIYQTLIALNLDTTVNDCLDKLLNDECTESTRENALYDYYALQLLPLQKAVRGHVLQFEWHQNSLLTNTHPNFLSKIRNINVQDALLTNQLYKNHELLKLERKKTEAVARLKSMNKSAINQYNRRQDKKNKRLKFGHRLIATHTNLERDEQKRAEKKAKERLQALKANDEEAYIKLLDQTKDTRITHLLRQTNAFLDSLTRAVKDQQKYTKEMIDSHIKEASEEVDDLSMVPKMKDEEYDDDDDNSNVDYYNVAHRIKEDIKKQPSILVGGTLKDYQIKGLQWMVSLFNNHLNGILADEMGLGKTIQTISLLTYLYEMKNIRGPYLVIVPLSTLSNWSSEFAKWAPTLRTISFKGSPNERKAKQAKIRAGEFDVVLTTFEYIIKERALLSKVKWVHMIIDEGHRMKNAQSKLSLTLNTHYHADYRLILTGTPLQNNLPELWALLNFVLPKIFNSVKSFDEWFNTPFANTGGQDKIELSEEETLLVIRRLHKVLRPFLLRRLKKDVEKELPDKVEKVVKCKMSALQQIMYQQMLKYRRLFIGDQNNKKMVGLRGFNNQIMQLKKICNHPFVFEEVEDQINPTRETNDDIWRVAGKFELLDRILPKLKATGHRVLIFFQMTQIMDIMEDFLRYINIKYLRLDGHTKSDERSELLRLFNAPDSEYLCFILSTRAGGLGLNLQTADTVIIFDTDWNPHQDLQAQDRAHRIGQKNEVRILRLITTNSVEEVILERAYKKLDIDGKVIQAGKFDNKSTSEEQEALLRSLLDAEEERRKKRESGVEEEEELKDSEINEILARNDEEMAVLTRMDEDRSKKEEELGVKSRLLEKSELPDIYSRDIGAELKREESESAAVYNGRGARERKTATYNDNMSEEQWLRQFEVSDDEKNDKQARKQRTKKEDKSEAIDGNGEIKGENIDADNDGPRINNISAEDRADTDLAMNDDDFLSKKRKAGRPRGRPKKVKLEGSENSEPPALESSPVTGDNSPSEDFMDIPKPRTAGKTSVKSARTSTRGRGRGRGRGRGRGRGRGRPPKARNGLDYVRTPAAATSPIDIREKVAKQALDLYHFALNYENEAGRKLSDIFLSKPSKALYPDYYMIIKYPVAFDNINTHIETLAYNSLKETLQDFHLIFSNARIYNTEGSVVYEDSLELEKVVTKKYCEIMGDNSQLDFTEFDEQYGTRPLVLPPVVTSSVAESFTDEADSSMTEASV

SEQ ID NO: 850 - protein, 884 aa, Saccharomyces cerevisiae
MDPNSNSSSETLRQEKQGFLDKALQRVKGIALRRNNSNKDHTTDDTTGSIRTPTSLQRQNSDRQSNMTSVFTDDISTIDDNSILFSEPPQKQSMMMSICVGVFVAVGGFLFGYDTGLINSITSMNYVKSHVAPNHDSFTAQQMSILVSFLSLGTFFGALTAPFISDSYGRKPTIIFSTIFIFSIGNSLQVGAGGITLLIVGRVISGIGIGAISAVVPLYQAEATHKSLRGAIISTYQWAITWGLLVSSAVSQGTHARNDASSYRIPIGLQYVWSSFLAIGMFFLPESPRYYVLKDKLDEAAKSLSFLRGVPVHDSGLLEELVEIKATYDYEASFGSSNFIDCFISSKSRPKQTLRMFTGIALQAFQQFSGINFIFYYGVNFFNKTGVSNSYLVSFITYAVNVVFNVPGLFFVEFFGRRKVLVVGGVIMTIANFIVAIVGCSLKTVAAAKVMIAFICLFIAAFSATWGGVVWVISAELYPLGVRSKCTAICAAANWLVNFICALITPYIVDTGSHTSSLGAKIFFIWGSLNAMGVIVVYLTVYETKGLTLEEIDELYIKSSTGVVSPKFNKDIRERALKFQYDPLQRLEDGKNTFVAKRNNFDDETPRNDFRNTISGEIDHSPNQKEVHSIPERVDIPTSTEILESPNKSSGMTVPVSPSLQDVPIPQTTEPAEIRTKYVDLGNGLGLNTYNRGPPSLSSDSSEDYTEDEIGGPSSQGDQSNRSTMNDINDYMARLIHSTSTASNTTDKFSGNQSTLRYHTASSHSDTTEEDSNLMDLGNGLALNAYNRGPPSILMNSSDEEANGGETSDNLNTAQDLAGMKERMAQFAQSYIDKRGGLEPETQSNILSTSLSVMADTNEHNNEILHSSEENATNQPVNENNDLK

SEQ ID NO: 851 - protein, 322 aa, Saccharomyces cerevisiae
MKPTQDSQEKVSIEQQLAVESIRKFLNSKTSYDVLPVSYRLIVLDTSLLVKKSLNVLLQNSIVSAPLWDSKTSRFAGLLTTTDFINVIQYYFSNPDKFELVDKLQLDGLKDIERALGVDQLDTASIHPSRPLFEACLKMLESRSGRIPLIDQDEETHREIVVSVLTQYRILKFVALNCRETHFLKIPIGDLNIITQDNMKSCQMTTPVIDVIQMLTQGRVSSVPIIDENGYLINVYEAYDVLGLIKGGIYNDLSLSVGEALMRRSDDFEGVYTCTKNDKLSTIMDNIRKARVHRFFVVDDVGRLVGVLTLSDILKYILLGSN

SEQ ID NO: 852 - protein, 172 aa, Saccharomyces cerevisiae
MLKIVTRAGHTARISNIAAHLLRTSPSLLTRTTTTTRFLPFSTSSFLNHGHLKKPKPGEELKITFILKDGSQKTYEVCEGETILDIAQGHNLDMEGACGGSCACSTCHVIVDPDYYDALPEPEDDENDMLDLAYGLTETSRLGCQIKMSKDIDGIRVALPQMTRNVNNNDFS

SEQ ID NO: 853 - protein, 109 aa, Saccharomyces cerevisiae
MSFFLNSLRGNQEVSQEKLDVAGVQFDAMCSTFNNILSTCLEKCIPHEGFGEPDLTKGEQCCIDRCVAKMHYSNRLIGGFVQTRGFGPENQLRHYSRFVAKEIADDSKK

SEQ ID NO: 854 - protein, 992 aa, Saccharomyces cerevisiae
MTTDNHQNDSVLDQQSGERTIDESNSISDENNVDNKREDVNVTSPTKSVSCISQAENGVASRTDESTITGSATDAETGDDDDDDDDDDDEDEDDEDEPPLLKYTRISQLPKNFFQRDSISSCLFGDTFFAFGTHSGILHLTTCAFEPIKTIKCHRSSILCINTDGKYFATGSIDGTVIIGSMDDPQNITQYDFKRPINSVALHSNFQASRMFVSGGMAGDVVLSQRNWLGNRIDIVLNKKKKKKTRKDDLSSDMKGPIMGIYTMGDLILWMDDDGITFCDVPTRSQLLNIPFPSRIFNVQDVRPDLFRPHVHFLESDRVVIGWGSNIWLFKVSFTKDSNSIKSGDSNSQSNNMSHFNPTTNIGSLLSSAASSFRGTPDKKVELECHFTVSMLITGLASFKDDQLLCLGFDIDIEEEATIDEDMKEGKNFSKRPENLLAKGNAPELKIVDLFNGDEIYNDEVIMKNYEKLSINDYHLGKHIDKTTPEYYLISSNDAIRVQELSLKDHFDWFMERKQYYKAWKIGKYVIGSEERFSIGLKFLNSLVTKKDWGTLVDHLNIIFEETLNSLDSNSYDVTQNVLKEWADIIEILITSGNIVEIAPLIPKKPALRKSVYDDVLHYFLANDMINKFHEYITKWDLKLFSVEDFEEELETRIEAASEPTASSKEEGSNITYRTELVHLYLKENKYTKAIPHLLKAKDLRALTIIKIQNLLPQYLDQIVDIILLPYKGEISHISKLSIFEIQTIFNKPIDLLFENRHTISVARIYEIFEHDCPKSFKKILFCYLIKFLDTDDSFMISPYENQLIELYSEYDRQSLLPFLQKHNNYNVESAIEVCSSKLGLYNELIYLWGKIGETKKALSLIIDELKNPQLAIDFVKNWGDSELWEFMINYSLDKPNFTKAILTCSDETSEIYLKVIRGMSDDLQIDNLQDIIKHIVQENSLSLEVRDNILVIINDETKKFANEFLKIRSQGKLFQVDESDIEINDDLNGVL

SEQ ID NO: 855 - DNA, 1482 bp, Saccharomyces cerevisiae
atgagctttgttcaaataaggcacatttcttcacaaataaaccgtaagactgtatccattgttggatcggggccttccggcttttatacagcgtaccatttactcaagaagtcaccgattccattaaatgttactatatgggaaaagttacctgttccttttggtttaagtagatatggtgtggcacctgatcatccagaagtcaaaaattgtgaagaaacgtttaccacatgtgcagaagagttttcttcccctacaaaccaaaagcataaattttcctttgttggtggtataaccattggaaaagaaatattgttgaaggaattgctggataatcaagatgctgttattttaagttatggttgtacaggggacagaaagctgaatatccctggcgaactcggaacaaaaggggtgtttagcagtagagaatttgtcaattggtacaatggtcatcctgatttcgcaaaggataagcgatttaccgattttgactggagcaaagtttcgaaagttggtattataggaaacggtaacgttgctcttgatattacgcgtgtacttatttctaatcaaattgatgaaatatgggaaaatacggacatctcatctcttgcactaaatttgctaagaagggcacctgtaaaggacgttaagctaattgcacgaagggatttcgttcattccaaattcaccaacaaagaattaagagaactatgggagttagaaaagtatggcatacgtggccgtattgatcctaaatttttccagaaagaaatgtttgacccatctaagtacgatcgtgcattcaatagacgagtagagatgtgtagtgagtatctcaagccatttaatgaacgttcgaagaaaaactataaaaaggctcctcctccaagcagcggatatgacaaattctgggagttagattatttgaagactcccttgaaaattaatagagacgattttggtgcaatcaactctttgagtttatgtaacaatcgattaaatgaagataacagtttgcaacccttgaaggacgtcaataatattatgacatataaagtggatttgctgattacttcattgggatatgcaggcgttcccatgcctgaattctctaagttgtctattggatttgacaaagatcatatagctaataaacagggtcgtgttttaacttccagcggagaaatattcccacatttatatgcatctggttggatccgtaagggcagccagggcgttattgcctcgacaatgcaagatgcttttgaagttggagacagagtaatacaagacttggtggtcagcggagcgctatccttagagaattctatcgacctctctaatatcaagcacaccacatggaaggattgggaaagaatcaacaagaaggaattgcttcggggcaaaaaggaacacaaaactcggtcaaagtttttaacttttgaagagttgtggaacggtgtagaaggcatataa

SEQ ID NO: 856 - DNA, 570 bp, Saccharomyces cerevisiae
atgaaagcaatagataaaatgacggataatccaccacaagaaggcttaagtgggaggaaaataatatatgacgaagatggcaaaccttgccgatcatgtaacaccctacttgactttcagtacgtgaccgggaagatatctaatggcctgaagaacctctcatctaacggtaaactagcaggtacgggggctctcactggcgaagcttcagagttgatgcctggctcaagaacatacaggaaggttgaccctcctgacgtagagcaactaggtagatcttcatggacgctgttacactctgtagctgccagctatcctgctcaacctacagaccaacagaagggtgaaatgaaacagttcttgaatatcttctcacatatttatccttgcaactggtgtgctaaagactttgaaaaatatatcagagaaaatgcaccacaagttgagtcaagagaagaacttgggaggtggatgtgtgaagcccacaataaagtcaataagaaattgaggaagcccaaatttgactgtaatttctgggaaaaaagatggaaggacggctgggacgaataa

SEQ ID NO: 857 - DNA, 903 bp, Saccharomyces cerevisiae
atgcctcataccgataagaaacaatcaggattagctcgtcttttggggtccgcctctgcaggcataatggaaattgccgtcttccatcctgtggacaccatttccaaaagactgatgtccaaccacaccaaaataacctctggccaggaattgaatcgtgttatttttcgtgatcatttcagcgaacctttgggcaaacgtttgtttaccttgttcccgggtctcggttacgctgcatcatacaaagttcttcaaagagtgtataaatatggtggtcagccttttgctaacgagtttttgaataagcactacaaaaaggattttgataatcttttcggtgaaaagactggtaaggcaatgagatccgccgctgctggatctttgattggtattggtgaaattgttcttttgccgctggacgtgttgaagattaagagacagaccaatcccgaatcgtttaaaggtagaggtttcatcaagattttgagagacgaaggcctgttcaacttatataggggttgggggtggacggctgccagaaatgctcccggttcattcgccctttttggtggtaatgcattcgccaaggagtatatcttgggtttgaaagattattctcaagctacttggtcccaaaacttcatctcctccatcgtcggtgcttgctcctctctgatcgtttctgctccattagatgtcatcaagacaagaattcaaaataggaattttgataatcctgaaagcgggttgagaatcgtcaaaaacactctgaaaaatgaaggtgtaactgcgtttttcaagggcttaacacctaaattactaacaacgggtccaaaactggttttctcatttgcgttagctcaatctttgatacctagattcgataacctgttgagcaaatga

SEQ ID NO: 858 - DNA, 333 bp, Saccharomyces cerevisiae
atggtatctcaagaaactatcaagcacgtcaaggaccttattgcagaaaacgagatcttcgtcgcatccaaaacgtactgtccatactgccatgcagccctaaacacgctttttgaaaagttaaaggttcccaggtccaaagttctggttttgcaattgaatgacatgaaggaaggcgcagacattcaggctgcgttatatgagattaatggccaaagaaccgtgccaaacatctatattaatggtaaacatattggaggcaacgacgacttgcaggaattgagggagactggtgaattggaggaattgttagaacctattcttgcaaattaa

SEQ ID NO: 859 - DNA, 1494 bp, Saccharomyces cerevisiae
atgttcatcagtagaagatgcagaattaaaggctttacccttaagaatttgctgtggttcaggtcatcatcaactcgatttgtttcaactgaatcaccagatgcgagcgcaattacgaaaccagatggtattttcaattattctctgttggaaaacagaacatacatcaggatacgaggacccgacacagtgaaatttctaaacggattagttacctcgaaactattacctcattttattaagaaaaatctaaccactgtagaagagaatgaagtgcctactgaagaaggaacgacgaaggttgatccaattattcctgtgccagaatttgatgcacgactgggaaattggggactgtataacgaaaaaggtattcaagggccatatatttcaaggtttggtttgtactctgcatttttaaacggtaaggggaagttaataacagatacaattatttaccccactcctgtgaccgtaagcgaacaaatttcaaattatcctgagtatctgttagagcttcacgggaatgtagtggacaaaattttgcacgttttacaaactcacaagttggccaataagattaaattcgaaaaaattgatcattcctccttgaaaacctgggatgttgaggttcaattccctaatttgcccaaagatattgaaaacccgtggtttgataatctactggatcctatggctctaccaaaaaattccatagatgctaataattttgctgttaatgttttaaattctttgtttaactcagatcctagaatattgggtatttacgtagaaagaagaactgagtcaatgtcaaggcattactccacatttccacaatccttcagagttgtcacttccgagcaagtggatgatctctctaagctatttaactttaacgttttcgacttcccttttcaagtaaataaaaaagcttccgttcaagttagagaaatcagatttcaaaaaggtcttatagatagcactgaggattacatatctgagactttgctacctttggaactaaactttgatttttttccaaacactataagcacaaacaaaggatgttatgtaggacaagagctgacagccaggacatatgctacaggcattctacggaaacgtttggtcccagttaagctggataattatcaacttttagatacagacccagaaagaaagtacgcagaattccatatcgacaacgttgtagaaaagagccttgcagagaacgagccaaccctcaatccatttaccaataaaccgcccgaacgaaccaagagaaagcaaaggccggcaggcttattgatttctaatgaagggctgtatggcgtagctttacttagaacagagcatttctctgctgccttctcatctgatgagccagtcgaattttacattactacaacgaagggtgaaaatattaaaataacacctcaaaaaccattctggtttagcgactggaaaaacaataacgggcctcataaatag

SEQ ID NO: 860 - DNA, 753 bp, Saccharomyces cerevisiae
atgataaacacaggaagaagcaggaattcagtactgctggcacacagattcctttcaactggaggattttggcgaggcggtacgaatggcacaatgtctcgcacaatcaacaacgtaaatcctttcaaattaaaattcataccgaagacagtgcccgcagctgcagactctgtctctccagatagtcaacgtccaggtaagaagcccttcaaattcatagtttccaatcagagcaagagtagcaaggcttctaaaagcccgaagtggtcgagctacgcattcccttcgcgtgagaccatcaaatctcatgaggaggccatcaagaagcagaataaagctatagacgagcaaatagctgctgcagtatccaagaatgactgctcttgcacagaacctcccaagaaaagaaagaggaaattgagaccaagaaaggcgctgatcaccctgagtccgaaggcaatcaagcatttaagggcactgctagctcagccggaacctaaattgattagagttagcgctagaaaccgtggatgttcaggactaacgtacgatctacaatatatcaccgagccggggaaattcgatgaggtagtagaacaagatggcgttaaaattgtcatcgattcaaaggcgttattcagcatcattggaagtgaaatggactggatcgacgacaagttggcctctaagtttgtcttcaagaatccaaactccaagggcacatgcggttgtggcgagagtttcatggtttaa

SEQ ID NO: 861 - DNA, 558 bp, Saccharomyces cerevisiae
atgcaggctaaattattgtttaccagactaaactttagacgtccctccacaactttacgccagtttcccctaacatgttttttatttcatagcaaagcattttactcggatctggtcactaaggagccgttgatcacaccgaaaagaataataaataagacgcctgggttaaacttatctatttctgagagggcttccaacagactagctgagatctaccgcaatagtaaggaaaatttaagaattagtgtggaaagtggtggatgtcacggtttccagtacaatctaactctagaacccgctaccaagccagatattaagaatgatgtcaaagacaaggagttttcagacgaccttgacgatgatgattccaaggatataatatacgtgttacccgaagataagggtcgagtgataattgatagtaaatcactaaacattttgaataacactacactgacatacactaatgagttgatcggttcttcgttcaaaatcatcaatggtagcctaaaaagtagttgtggttgtggaagtagttttgatattgaaaattaa

SEQ ID NO: 862 - DNA, 555 bp, Saccharomyces cerevisiae
atgttgaaatacttggttcaacgaagattcacttctacattttacgagctgttcccaaagaccttccccaaaaagctacccatttggactatcgatcaatccagattaaggaaggagtataggcaattacaagcacagcaccatccagacatggcccaacaaggtagtgaacagtcatcaactcttaatcaagcttaccatactctcaaagatccccttagaaggtcacaatatatgctaaaactcttgcgcaatatcgatttgacgcaagaacagacctcaaatgaagtaactaccagtgatccacagttactattgaaagttctagacatccatgatgaattatcccagatggacgacgaagctggtgtgaagctgcttgaaaagcaaaacaaggaaagaattcaagatattgaagcccagttgggacaatgctacaatgacaaggattacgccgccgcagtgaagttgaccgtggagctaaagtactggtacaacttggccaaggcattcaaagactgggctccaggaaaacaattggaaatgaatcactaa

SEQ ID NO: 863 - DNA, 687 bp, Saccharomyces cerevisiae
atgagagctttttcagcagccaccgttagggccacaactaggaagtcgttcatcccaatggcaccaagaactccttttgtgactccatcatttacaaagaatgtaggctcaatgagaagaatgagattttattctgatgaagccaaaagtgaagaatccaaagaaaacaatgaagatttgactgaagagcaatcagaaatcaagaaattagagagccagttaagcgcgaagactaaagaagcttctgaactcaaggacagattattaagatctgtggcagatttcagaaatttacaacaagtcacaaagaaggatattcagaaagctaaggactttgctttacagaagtttgcaaaggatttattggaatctgtagataactttggtcatgctttgaatgcttttaaagaggaagacttacaaaagtccaaggaaattagtgatttgtatacaggggttagaatgacaagagatgtttttgaaaacaccctaagaaagcacggtattgaaaaattagacccattgggagaaccatttgatccaaataaacacgaagcaacgttcgagttgccacaacctgataaggaaccgggtactgttttccatgtacaacaattaggtttcaccttgaatgacagagttatcagaccagcaaaagtcggaattgttaagggcgaagagaactaa

SEQ ID NO: 864 - DNA, 1494 bp, Saccharomyces cerevisiae
atgttgaaatcaactgctacaagatcgataacaagattatctcaagtttacaacgttccagcggccacatatagggcttgtttggtaagcaggagattctattcccctcctgcagcaggcgtgaagttagacgacaacttctctctggaaacgcataccgatattcaggctgctgcaaaggcacaggctagtgcccgtgcgagtgcatccggtaccaccccagatgctgtagtagcttctggtagcactgcaatgagccatgcttatcaagaaaacacaggttttggtactcgtcccatatatcttgacatgcaagccactacaccaacagaccctagggttttggatacgatgttgaagttttatacgggactttatggtaatcctcattccaacactcactcttacggttgggaaacaaatactgctgtggaaaatgctagagctcacgtagcaaagatgatcaatgccgaccccaaggaaataatattcacttcgggagcgaccgaatctaataatatggttcttaagggtgtcccaagattttataagaagactaagaaacacatcatcaccactagaacggaacacaagtgtgtcttggaagccgcacgggccatgatgaaggagggatttgaagtcactttcctaaatgtggacgatcaaggtcttatcgatttgaaggaattggaagatgccattagaccagatacctgtctcgtctctgtgatggctgtcaataatgaaatcggtgtcattcaacctattaaagaaattggtgcaatttgtagaaagaataagatctactttcatactgacgccgcacaagcctatggtaagattcacattgatgtcaatgaaatgaacattgatttactatcaatttcttctcacaagatttacggtccaaagggaataggtgccatctatgtaagaaggagaccaagagttagattagaacctttactatccggtggtggccaagagagaggattgagatctggtactttggcccccccattggtagcgggatttggtgaagctgcgagattgatgaagaaagaatttgacaacgaccaagctcacatcaaaagactatccgataaattagtcaaaggtctattatccgctgaacataccacgttgaacggatctccagatcatcgttatccagggtgtgttaacgtttctttcgcctacgtggaaggagaatctttattgatggcactaagggatatcgcattatcctcgggttcagcctgtacatctgcttccctagaaccttcttatgttttacatgcgctgggtaaggatgatgcattagcccattcttccatcagatttggtattggtagatttagtactgaagaggaggtcgactacgtcgttaaggccgtttctgacagagtaaaattcttgagggaactttcaccattatgggaaatggttcaagaaggtattgacttaaactccatcaaatggtcaggtcattga

SEQ ID NO: 865 - DNA, 771 bp, Saccharomyces cerevisiae
atgttcaaatcagtggctaaattggggaagtctccgattttttacttaaattctcagagattaattcatattaagactttaacaactccaaatgaaaatgctttaaaatttctctccacagatggcgagatgctacagacgcgtggctccaagagtatagttattaagaacactgatgaaaacctcatcaaccattccaagttagcacagcaaatttttttgcagtgtccaggagtggagtctttaatgataggtgatgattttctcactattaataaagacagaatggtccattggaatagtatcaagcctgaaattatagatttgttaaccaagcaacttgcttacggtgaagatgttatatccaaagaattccatgctgtccaagaagaagaaggagaaggtggctacaaaataaatatgcccaaatttgaacttaccgaagaagatgaagaggtcagcgaattgattgaagagctgatagatacaagaataagaccagccatcttggaggacggcggtgatatcgattaccgtgggtgggatccaaagactggaaccgtttatttaagattacaaggtgcatgtacctcatgctcttctagtgaagtgactttgaagtacggtattgagtccatgttgaagcactatgtggatgaagtgaaagaagtgattcagatcatggatcctgagcaagaaatagcattaaaggaatttgataagcttgaaaaaaagttggaatcgagtaaaaatacaagccatgaaaagtaa

SEQ ID NO: 866 - DNA, 1902 bp, Saccharomyces cerevisiae
atgagcagtaacaacaacacaaacacagcacctgccaatgcaaattctagccaccaccaccaccatcaccaccatcaccaccaccatcacggtcatggcggaagcaactcgacgctaaacaatcccaagtcgtccttagcggatggtgcacatatcgggaactaccaaatcgtcaaaacgctgggagaggggtcctttggtaaagttaaattggcatatcataccactacgggccaaaaagttgctctaaaaatcattaataagaaggttttggcaaagagtgatatgcagggcagaattgaaagagaaatatcttatctgagactcttaagacacccccacatcatcaaactgtatgatgttatcaaatccaaagatgaaatcattatggttatagagtacgccgggaacgaattgtttgactatattgttcagagagacaaaatgagcgagcaagaggcaagaagatttttccagcagatcatcagtgccgtcgagtactgccataggcacaaaattgtccatagagatctgaagcctgaaaacttactactagatgagcatctgaatgtaaagattgccgattttggtttgtcaaacatcatgactgatggtaatttcttaaagacttcttgtggttctcccaattatgcggctcctgaagttatcagcggtaagctgtacgcaggcccagaagtggacgtgtggtcatgtggggttatcctttatgttatgctttgtcgtcgtctaccgtttgacgatgaaagcatcccagtgcttttcaagaatatcagcaacggtgtttacaccttgcctaaatttttatctcctggagctgctgggctaatcaaaagaatgttaatcgttaatccattgaacagaataagcattcatgaaattatgcaagacgattggttcaaagttgacctgccagaatatctacttccaccagatttgaaaccacacccagaagaagagaatgaaaataatgactcaaaaaaggatggcagcagcccagataacgatgaaattgatgacaaccttgtcaatattttatcatcgaccatgggttacgaaaaagacgagatttatgagtccttagaatcatcagaagacactcctgcattcaacgaaattagggacgcgtacatgttgattaaggagaataaatctttgatcaaggatatgaaggcaaacaaaagcgtcagtgatgaactggatacctttctgtcccagtcacctccaacttttcaacaacaaagcaaatcccatcaaaagagtcaagtagatcatgaaactgccaagcaacacgcaagaaggatggcaagtgctatcactcaacaaaggacatatcaccaatcacccttcatggatcagtataaagaagaagactctacagtttccattttgcctacatctttacctcagatccacagagctaatatgttagcacaaggttcgccagctgcctctaaaatatctcctcttgtaacgaaaaaatctaaaacgagatggcattttggtatacgatctcgctcatatccattagacgttatgggtgaaatttatattgccttgaagaatttgggtgccgaatgggccaagccatctgaagaggatttatggactatcaaattaaggtggaaatatgatattggaaacaagacaaacactaatgaaaaaatacctgatttaatgaaaatggtaattcaattatttcaaattgaaaccaataattatttggtggatttcaaatttgacggctgggaaagtagttatggagatgatactactgtttctaatatttctgaagatgaaatgagtactttttcagcctacccatttttacatttaacaacaaaactaattatggaattagccgttaacagtcaaagcaattga

SEQ ID NO: 867 - DNA, 5112 bp, Saccharomyces cerevisiae
atgaacataccacagcgtcaatttagcaacgaagaggtcaaccgctgctatttaagatggcagcatttgagaaatgaacacggaatgaacgctccgagtgtgccggaatttatctatttgactaaagtgttgcaatttgctgccaagcagcgacaagaattacaaatgcaacgccaacagcaaggcatttcaggttctcagcaaaatattgttccaaattcttcagatcaagcagaactgccgaataatgcttcctcgcacatttctgcttctgcttccccgcatttagctccgaatatgcaattgaatggaaatgagacctttagcacttctgctcatcaatcaccaatcatgcaaacacagatgccattaaatagcaatggtggtaataacatgctaccacaacggcaatcttcggttggttcattaaatgcaactaatttttcaccaacaccagcaaacaatggagaaaatgctgcggagaaaccagataactcaaaccataataacttaaaccttaataattccgagcttcaaccgcaaaatcgatcattacaagaacacaacatacaggattcaaatgtgatgccaggttcgcagataaattctcctatgccccagcaggcgcagatgcagcaggcacaattccaagcacaacaggcgcaacaagcgcaacaggcacaacaggcacaacaagcacaagcgagactgcaacaggggagaagattacccatgacaatgtttactgccgagcaatccgaactgttaaaggcccaaatcacatctctaaaatgtctagtaaatagaaagcctattccgtttgaatttcaggctgttatccaaaaatctattaaccatcctccagatttcaaaagaatgttactgtctttgagtgagtttgcgagaagaagacaacccacagatcaaaataaccaatcaaatctcaatggcggcaacaatacgcagcaacccggcaccaattcccactacaataacactaacactgacaacgtttctgggcttaccagaaatgcacctttagatagcaaagacgaaaattttgcatctgtttcaccagctggtccatctagtgtacataatgcgaagaatggcaccctcgataaaaattcgcaaactgtaagtggcactccaatcacgcaaacagaatcgaaaaaagaggaaaacgaaaccatttcaaacgtagctaaaacagctcctaatagtaataagacccacaccgagcaaaataacccgccaaaaccgcagaaacccgttcctttaaacgtccttcaagatcaatataaggaaggaataaaagtggtagatatagatgatcctgatatgatggttgattcttttacgatgcccaatatctcacatagtaatatcgattatcagactttattggccaattcggatcatgcaaagtttactattgaacctggcgttctaccggttggtattgacacacataccgctactgacatttaccaaactttaattgcattgaacctagatactacggtaaatgactgtttggataagctactaaatgacgaatgtacggaatcaaccagggaaaatgctctttacgattactacgccttacaattattaccgttacaaaaagccgtaagaggtcatgtattacaatttgaatggcatcaaaattctttattaaccaatacacatccaaattttctttcgaaaataagaaacatcaacgttcaagatgcattgctaacaaaccaactttataagaatcatgaattacttaagttagaaaggaagaagactgaggcagtggccagattaaagtcgatgaataaatccgccatcaatcaatataatagaagacaagataaaaagaataaaaggttgaagtttggccatagactcattgctacgcatactaatttagaaagggatgagcaaaagagagctgaaaaaaaggcaaaagaacgtttacaggctttaaaggcgaacgatgaggaagcctatataaaattattagaccaaaccaaagatacaagaattacacatcttctaaggcaaacaaacgcatttttagattctttaacaagagccgtgaaagatcaacaaaagtacactaaagaaatgattgattcccacataaaggaagcatcggaggaagtggatgatttgtccatggtccccaagatgaaggatgaagaatatgatgacgacgacgacaattctaacgtcgattattacaatgtcgcacatagaattaaagaagatatcaagaagcagccttcaatattggttggtggtaccttaaaggactatcaaatcaagggtttacagtggatggtttcgcttttcaataatcatttaaatggtattttagcagacgaaatgggtcttggtaagactatccagacgatatccttacttacatatttatatgaaatgaagaatattcgtgggccatatttagtcattgttcctttatctacactgtcaaattggagcagtgaattcgcgaaatgggctcctaccttaagaactatatcatttaaaggttcgccaaatgagaggaaagccaaacaggctaaaataagggcaggtgaatttgatgtagttctgactacctttgagtatattattaaagaaagagcacttttatccaaggtcaagtgggtccatatgattattgatgaaggccatagaatgaaaaatgcgcaatccaagctttctttaaccttgaacacacattaccatgcagattatagattaattttgacaggtacaccacttcaaaacaacttgccagaattatgggccttattgaattttgtgttacccaagattttcaattccgtgaaatcttttgatgaatggttcaatacaccctttgccaacaccggtgggcaagataaaattgagttgagtgaagaagagacgcttttggttatcaggagattgcataaagtcttgagaccctttttattgcgtcgtttgaaaaaggatgtagaaaaagaattaccggataaagttgagaaggtagtgaagtgcaaaatgagcgctttacaacaaattatgtaccaacaaatgttgaaatatcgtcgtctttttatcggtgatcaaaataataagaaaatggtaggtttaagaggtttcaataatcaaatcatgcaactaaagaaaatctgtaatcatccttttgtatttgaagaagttgaggaccaaatcaatccaacaagagaaacgaatgatgatatttggcgtgttgctggtaaatttgaactattagatagaattttgcctaagcttaaggcaactgggcatagagtattaattttttttcaaatgacccaaattatggatattatggaagattttttaaggtacattaatatcaagtacctgaggttagatggtcatacaaaatctgatgaacgtagtgagttgttacgtctatttaacgcccctgattctgaatacttgtgctttatcttatcaactagagcgggtggtttgggtttaaatttacaaactgcagacactgtcattatttttgatactgactggaatcctcatcaagatttgcaagctcaggatagagcgcatagaataggtcagaagaatgaagttagaattctaagattgattactacgaattcagttgaagaagttatcctagagagagcctacaagaagctagatatcgatggtaaagtcattcaagcaggtaaattcgataacaaatctacatcggaggaacaagaagcgttgcttagatctttgctggatgcagaagaggaacgtagaaagaaaagagagtctggtgttgaagaagaagaggagttaaaagactcagaaatcaacgaaattcttgctcgaaatgacgaagaaatggctgttcttacaaggatggatgaagatagatcaaagaaggaggaagaattgggagtaaagagccgtctcttagaaaagagtgaattacctgatatttacagtagagatattggtgccgagctcaaacgtgaagaatcagaatctgctgctgtttacaatggaaggggtgcaagagaacgtaagacggcaacttacaacgataatatgtctgaagaacagtggttaagacaatttgaagttagcgatgatgaaaaaaatgacaagcaggcaagaaaacaacgaacaaagaaggaagataagagcgaggcgattgatgggaatggagaaattaaaggcgaaaacattgacgctgataatgacggtcctagaattaataatatatcggccgaagatcgggcagatacggatttggcaatgaatgacgatgatttcttgtctaaaaagagaaaggcaggaaggccccgtggaagacctaagaaagtgaaacttgaaggatctgaaaattctgaaccaccagcgcttgaatcaagtccagttactggcgataactctcccagtgaggattttatggacattccaaaaccacgtacagcgggaaaaacatctgttaaatcagcaagaacttcaacaaggggccgtggtcgcggtcgtggtcgtggtcgagggcgaggacgtggacgaggaaggccgccaaaagcaagaaatgggcttgattatgtccgcacgcccgctgcggcaacgagtcctattgatattagagagaaagttgctaaacaagctctagacttataccactttgctctcaattatgaaaatgaagctggaaggaaactttctgacattttcctctccaaaccttccaaagcactatatcccgactactatatgattattaagtaccctgtcgcctttgataatattaacacgcatattgaaacgctagcttacaactcccttaaagagacccttcaagactttcatctgatattttccaatgctaggatatacaatactgagggttcagtagtatacgaagactctttagaactggaaaaagtggttacgaagaaatactgtgagataatgggcgataactcacaactcgactttactgaatttgatgaacagtatggcaccagacccctcgtcttgcctcctgttgttacttcaagcgtggctgaatctttcacagatgaagcggactcgagcatgacagaagcgagtgtatag

SEQ ID NO: 868 - DNA, 2655 bp, Saccharomyces cerevisiae
atggatcctaatagtaacagttctagcgaaacattacgccaagagaaacagggtttcctagacaaagctcttcagagggtgaagggcatagcactgcgacgaaacaatagtaacaaagatcatacaacagatgatacgacaggtagcatacgaacccctacgagcttgcagcggcaaaattctgacaggcaatctaatatgacatccgtgtttacggatgacatttctaccatagacgacaactcaattttattttcagagcctcctcagaaacaatctatgatgatgtctatatgcgtaggtgtttttgttgcagttggcggatttttatttggttatgatacaggtctgatcaacagtattacatctatgaactatgtgaagtcacacgtagcacctaatcacgattcatttaccgcccaacaaatgtccattttggtgtcatttttgtcattgggaactttttttggggctttaactgcaccatttatatctgattcgtatggcaggaagcctactatcattttcagtacaattttcatcttctctatcggaaattctttacaggtaggtgctggaggaatcacattattgattgtgggaagggtcatttcaggtatcggtataggcgcaatttcagcggttgttccattataccaagcagaagctacacataaatcattaagaggtgctattatttctacttaccaatgggccattacctggggcttgctcgtgtcaagtgcagtgtcgcaagggacacacgcaagaaacgacgcatcttcgtatcggattcccatagggttgcaatatgtctggtcgtcatttctcgctatcgggatgttctttctccctgagagtccacgctattacgttttgaaagacaagctagatgaagcagctaaatctttatcgtttttaagaggtgtaccagtccatgattctgggttactggaagaactagttgaaataaaggcaacatatgattacgaggcatcttttggttcttcgaacttcattgattgttttatttcaagtaaaagtagaccaaagcaaactctaaggatgtttacgggaattgcccttcaagcatttcaacaattttcaggtatcaactttatattttactacggtgtcaatttcttcaataagacaggagtcagtaatagttatctggtttcatttataacctatgctgttaatgttgtctttaatgttcctggtttgttttttgtggaattttttggtagacgtaaggtgctggttgttgggggtgttatcatgactatagccaactttattgtggccattgttgggtgttccttaaagactgtagcggccgcaaaagttatgatagcatttatatgtctattcatagctgccttttctgctacatggggtggtgttgtttgggttatttcagcagaactgtacccattgggtgtgagatctaaatgtacggctatatgcgctgctgctaactggcttgtaaactttatttgtgctttaattaccccttatattgtagatactgggtcgcatacatcatcattaggtgcaaaaatattcttcatttggggctccttaaatgcgatgggggtgatagttgtttacttgaccgtttatgaaacgaagggtttgacattagaagagattgatgaattatatattaagtcatccactggtgtcgtgtcaccaaaatttaataaagatattagggaacgcgcacttaaattccaatacgatcctttgcaaagattagaagacggaaagaacacttttgttgctaaaagaaataattttgacgatgaaacaccaagaaatgattttcgaaatacgatatcgggcgaaatagatcatagtcccaatcaaaaagaagttcattctatcccagaacgtgttgatattcctactagtacagaaattcttgaaagcccgaacaaaagtagtggtatgacagtccctgtgtcaccttctctgcaagacgttccaatcccgcaaacaacagagcctgctgaaattcgaaccaaatatgtggacctaggaaatgggcttggtcttaatacgtataatagagggcctccctcactctcaagcgactcaagcgaagattacacagaagatgaaataggcgggccctcatctcaaggcgaccaaagtaatagaagtactatgaatgatattaatgattatatggcacgtctcattcacagtacttctactgcaagtaacacgacagataagttctccggtaaccaaagtacccttcgttaccacacggcttcctcacattcggatacaactgaagaggacagcaatttgatggacctgggaaacgggcttgccttgaatgcttataacagaggtccaccttcaattttaatgaattccagtgatgaagaggcaaatggtggtgagacgtctgataatttgaacacagctcaagacttggctggtatgaaggaacgaatggcgcagtttgcgcagagctatattgacaagagaggcggtctggaacctgaaactcaatctaatattttgagcacttctctctccgtgatggctgacactaatgaacataataatgaaatcctccactcaagcgaagaaaacgccactaatcaacctgtaaatgaaaataatgatttgaaataa

SEQ ID NO: 869 - DNA, 969 bp, Saccharomyces cerevisiae
atgaaaccgacacaggattcacaagaaaaggtttctattgaacagcagttagctgtagaatcgataaggaagtttttgaactcgaaaacatcttatgacgtgttgcctgtttcttaccgtttaattgtcttggacacctcgttgttagtgaagaaatcactgaatgttcttttgcaaaatagcattgtctctgcgccattatgggactccaagacttccaggttcgctggacttctaactactacagattttattaatgtcatccagtattacttctccaatccagataagttcgaattagtagacaaattacagttagatggattaaaagatatagagcgtgctctcggtgttgatcaactagatacagcttcaattcatccttctagacccttatttgaggcgtgtcttaagatgttagaatcaagaagtggtagaataccactgatcgatcaagatgaagagacacatagagaaattgtcgttagtgttcttacgcaatatagaattctgaagttcgttgctttaaattgcagggaaacacattttctaaagattccaattggggacttgaacattattacgcaagataacatgaaaagctgtcaaatgaccactccggtcatagacgtcattcagatgcttacccaaggtcgggtttcttccgtccctattattgacgaaaacggctacttaatcaacgtatatgaagcatacgatgtcctaggcttgataaaaggaggcatctacaacgacctgtcattgagcgtcggagaagcccttatgaggagaagtgatgattttgagggtgtttatacatgcactaagaatgataaattatctactattatggataacatcagaaaagcaagggtgcatagattctttgtagttgatgacgtcggacggttggttggtgtcttgacgttaagcgatattctcaaatatatccttctaggtagcaactga

SEQ ID NO: 870 - DNA, 519 bp, Saccharomyces cerevisiae
atgctgaaaattgttactcgggctggacacacagctagaatatcgaacatcgcagcacatcttttacgcacctctccatctctgctcacacgcaccaccacaaccacaagatttctgcccttctctacgtcttcgttcttaaaccatggccatttgaaaaaaccgaaaccaggcgaagaactgaagataacttttattctgaaggatggctcccagaagacgtacgaagtctgtgagggcgaaaccatcctggacatcgctcaaggtcacaacctggacatggagggcgcatgcggcggttcttgtgcctgctccacctgtcacgtcatcgttgatccagactactacgatgccctgccggaacctgaagatgatgaaaacgatatgctcgatcttgcttacgggctaacagagacaagcaggcttgggtgccagattaagatgtcaaaagatatcgatgggattagagtcgctctgccccagatgacaagaaacgttaataacaacgattttagttaa

SEQ ID NO: 871 - DNA, 330 bp, Saccharomyces cerevisiae
atgtcgttctttttaaatagtctaaggggcaaccaggaggtctcgcaagagaagctagacgttgcaggagtgcaattcgatgcgatgtgctcgactttcaacaatattctcagtacgtgtcttgagaaatgtattccgcatgagggctttggtgagcctgatctaacgaaaggtgagcaatgctgcatagacagatgtgtggcaaagatgcattacagcaatcgcctcattggaggatttgtacaaacacgaggtttcgggccagagaatcagctacgacattattcgcgatttgtggccaaagaaatagctgatgattccaaaaaatag

SEQ ID NO: 872 - DNA, 2979 bp, Saccharomyces cerevisiae
atgactacagataatcatcagaatgattctgttttggatcaacaatcaggcgaacgaacaattgatgagagtaattccatctctgacgagaataatgttgataataagagggaagacgttaatgtaacttcaccaacaaaaagtgttagttgcatatcacaagcggaaaatggagtagcttctcgaacagatgagagtacaataacaggaagtgcgacggatgcagaaacaggtgatgatgatgatgatgatgatgatgacgatgatgaagatgaggatgacgaagatgagccccccttattgaagtacacacgaattagtcaactcccgaagaacttttttcaacgagactcgatctcttcatgtttatttggtgatactttttttgcatttggtacacactcaggcattctacacttaactacatgcgcgttcgaacccattaaaaccatcaaatgccatagatcttcgatactttgtattaacactgacggaaaatattttgctacgggatctattgacgggacagtgattatcggatcgatggatgatccacaaaacattacacaatacgatttcaaaagacctataaactctgtagcgttgcactcaaattttcaagcatccagaatgtttgtttctggtggaatggctggcgacgttgtactatctcagagaaattggctaggaaatagaatcgacatcgttttaaacaagaagaaaaagaaaaaaacaagaaaagatgacctatcctctgatatgaagggccctatcatgggaatttatactatgggtgaccttatattatggatggatgatgatggaataacattttgcgatgttcctacaagatcacagcttttgaatattccattcccctccagaatttttaacgtacaggatgtaaggccagatctatttagaccccatgttcattttttagaaagtgatcgtgtcgttatcggatggggatctaatatttggctatttaaagtttcctttaccaaggattcaaattcgatcaaatccggtgactctaattctcaaagtaataatatgagtcattttaaccctacgacaaacatcggatctctcttgtctagtgctgcatcgagttttagagggacacctgataagaaagttgaattagaatgccattttactgtgtcaatgttgattacagggcttgcatcgtttaaggatgatcagttattatgcctaggttttgatatagatattgaagaggaagcaaccatagatgaagatatgaaggaggggaagaattttagcaagcggccagaaaacttattagccaaagggaatgctccagaattaaaaattgttgatctttttaatggtgatgaaatctataatgatgaagttatcatgaaaaactatgaaaaattgtctataaatgattatcacctcggtaaacatatagataaaacaacaccagaatactatttgataagttccaacgatgccatcagggttcaagagttatcattgaaggatcatttcgattggtttatggaaagaaagcaatattataaagcttggaaaatcggtaaatatgtaattggatcagaagagaggtttagtatagggttgaaattcctcaactctttagtaactaaaaaagattggggtacattagtggaccacttaaatattattttcgaagaaactttaaactcattggattccaactcatatgatgtcactcaaaacgtgctgaaagaatgggcagatataatagagattttgattacatcaggaaatattgtagaaattgcgcctttgattcccaagaaacctgccttaagaaagtcggtatatgacgatgtattacattactttttggccaatgacatgatcaataagtttcatgagtatattactaagtgggatttaaagcttttttctgtggaagatttcgaagaagagctagaaacaagaatagaggctgctagtgaacctacagcttcatcgaaggaagaagggtctaatattacctatagaactgagttggtgcatttatatttgaaagagaataaatataccaaggctataccgcaccttttgaaagctaaggacttaagagctttaactattataaaaatacaaaatttattgccgcagtatctagaccagatagttgatatcattcttttaccatataagggtgaaatttcccatatttccaaactatcaatatttgaaattcaaacaatttttaacaaaccaatagacctgttgtttgaaaatagacacaccatatcagtcgctagaatatacgaaatatttgaacatgattgtccaaaaagtttcaaaaagattttattttgttatttaataaaatttttagatacggacgactcgttcatgataagtccttatgaaaatcaactaattgaactttattctgaatacgaccgacaaagccttctgccttttctgcaaaagcacaataactataatgtagagagtgccatcgaagtctgttcatcgaaacttggtttatataatgaactgatctatttgtgggggaaaatcggtgaaacgaagaaagcattgtctttgattattgacgagttaaaaaacccgcaattagctatagattttgttaaaaactggggtgattcagaactttgggaattcatgattaactatagtcttgacaaacctaattttactaaagccattttaacatgttctgatgagaccagcgaaatttacctaaaagtgatcagaggtatgtccgatgatctgcaaattgacaacctgcaggatattattaaacatatcgttcaagaaaattcattaagcttggaagttagagataatattttggttatcattaatgatgaaacgaaaaaatttgccaatgaattcctgaaaataagaagtcaaggtaaattgtttcaagtagacgaaagcgatattgaaattaatgacgacttaaatggtgttttataa

SEQ ID NO: 873 - protein, 107 aa, Azotobacter vinelandii DJ
MITLTESAKSAVTRFISSTGKPIAGLRIRVEGGGCSGLKYSLKLEEAGAEDDQLVDCDGITLLIDSASAPLLDGVTMDFVESMEGSGFTFVNPNATNSCGCGKSFAC

SEQ ID NO: 874 - protein, 402 aa, Azotobacter vinelandii DJ
MADVYLDNNATTRVDDEIVQAMLPFFTEQFGNPSSLHSFGNQVGMALKKARQSVQKLLGAEHDSEIVFTSCGTESDSTAILSALKAQPERKTVITTVVEHPAVLSLCDYLASEGYTVHKLPVDKKGRLDLEHYASLLTDDVAVVSVMWANNETGTLFPIEEMARLADDAGIMFHTDAVQAVGKVPIDLKNSSIHMLSLSGHKLHAPKGVGVLYLRRGTRFRPLLRGGHQERGRRAGTENAASIIGLGVAAERALQFMEHENTEVKRLRDKLEAGILAVVPHAFVTGDPDNRLPNTANIAFEYIEGEAILLLLNKVGIAASSGSACTSGSLEPSHVMRAMDIPYTAAHGTVRFSLSRYTTEEEIDRVIREVPPIVAQLRKLSPYWSGNGPVEDPGKAFAPVYG

SEQ ID NO: 875 - protein, 312 aa, Azotobacter vinelandii DJ
MWDYSEKVKEHFYNPKNAGAVEGANAIGDVGSLSCGDALRLTLKVDPETDVILDAGFQTFGCGSAIASSSALTEMVKGLTLDEALKISNQDIADYLDGLPPEKMHCSVMGREALQAAVANYRGETIEDDHEEGALICKCFAVDEVMVRDTIRANKLSTVEDVTNYTKAGGGCSACHEAIERVLTEELAARGEVFVAAPIKAKKKVKVLAPEPAPAPVAEAPAAAPKLSNLQRIRRIETVLAAIRPTLQRDKGDVELIDVDGKNVYVKLTGACTGCQMASMTLGGIQQRLIEELGEFVKVIPVSAAAHAQMEV

SEQ ID NO: 876 - protein, 265 aa, Azotobacter vinelandii DJ
MSLLTQWRDDIRCVFERDPAARTTFEVLTTYPGVHAIIGYRLANRLWRAGWRYPARLLSFVARMLSNVDIHPGATIGERFFIDHGACVVIGETAEIGNDVTLYHGVTLGGTSWNKGKRHPTLRDGVLVGAGAKILGPITVGAGARVGANSVVVQDVPDGCTVVGIPGKVVKVREAGRPNPYGIDLDHHLIPDPVGKAIACLLERIDALEKQVEAGGLVTVGSQQQFYQVCNSDNSICESDCAGGTTAQAQQSAGRRRAVPTPVAE

SEQ ID NO: 877 - protein, 116 aa, Azotobacter vinelandii DJ
MTVETFTPTPLLFTQGAANKVKTLISEEGNPRLKLRVFVTGGGCSGFQYGFTFDEDVAEDDTIVEREGVSLVVDPMSFQYLAGAEVDYQEGLEGSRFVIKNPNAATTCGCGQSFSV

SEQ ID NO: 878 - protein, 194 aa, Azotobacter vinelandii DJ
MSAITITDAAHDYLAELLAKQNGTDIGIRIFITQPGTPAAETCLAYCKPHERHPDDIAQALKSFTLWIDAVSEPFLEDAIVDYANDRMGGQLTIKAPNAKVPMIDEDSPLGERINYYLQTEINPGLASHGGQVSLVDIVEEGIAVLRFGGGCQGCGMVDMTLKDGVEKTLLERIPDLKGVRDATDHSNRENAYY

SEQ ID NO: 879 - protein, 96 aa, Azotobacter vinelandii DJ
MNTQPDLERSAAKPLTEEQRSSIITETIERLRPGLQADGGDMEIVSIDGYKVRLRLKGMCAGCTASGETLGGIRRQLMLALGENEPILVLPELPPL

SEQ ID NO: 880 - protein, 96 aa, Azotobacter vinelandii DJ
MSNPPLDTEENATTLAITPIPAESLPLVRETVERLRPGVQRDGGDLELVAVQDNIVRLRLKGACVGCAMSAQTLGGVRRELVKVLDNPSVRVLPAP

SEQ ID NO: 881 - protein, 387 aa, Helicobacter pylori B38
MLQRIYLDNNATTRIDPKVKEIMDPFLRDHYGNPSSLHQFGTETHPAIAEALDKLYKGINARDIDDVIITSCATESNNWVLKGVYFDECLKKGKNHIVTTVAEHPAVRSTCNFLESLGVEVTYLPINEHGSITAEQVKEAITEKTALVSVMWANNETGLIFPIEEIGAICKEKGVLFHTDAVQAIGKIPVDVLKANADFLSFSAHKFHGPKGIGGLYIRSGVGLTPLFHGGEHMNGRRSGTLNVPYIVGMGEAMRLAVEHLDYEKEVVGKLRDKLEEALLKIPDVMVVGDRIHRVPNTTLVSVRGIEGEAMLWDLNRSNIAASTGSACASEDLEANPVMVAIGASKELAHTAIRLSLSRFNTEAEIDKTIEVFSQAAVRLRNISSSY

SEQ ID NO: 882 - protein, 326 aa, Helicobacter pylori B38
MAKHDLVGSVLWDAYSKEVQRRMDNPTNLGVITEEQAKAKNAKLIVADYGAEACGDAVRLYWLVDESTDTIIDAKFKSFGCGTAIASSDMMVELCLNKRVQDAVKITNLDVERGLRDDPDTPAVPGQKMHCSVMAYDVIKKAAGMYLGKNAEDFEEEIIVCECARVSLGTIKEVIRLNDLKSVEEITNYTKAGAFCKSCVRPGGHEKRDYYLVDILKEVREEMEAEKLKAAANKSQSGELAFREMTMVQKIKAVDKVIDENIRPMLMMDGGDLEILDIKESDDYIDVYIRYMGACDGCMSATTGTLFAIENALQELLDRSIRVLPI

SEQ ID NO: 883 - protein, 404 aa, Escherichia coli str. K-12 substr. MG1655
MKLPIYLDYSATTPVDPRVAEKMMQFMTMDGTFGNPASRSHRFGWQAEEAVDIARNQIADLVGADPREIVFTSGATESDNLAIKGAANFYQKKGKHIITSKTEHKAVLDTCRQLEREGFEVTYLAPQRNGIIDLKELEAAMRDDTILVSIMHVNNEIGVVQDIAAIGEMCRARGIIYHVDATQSVGKLPIDLSQLKVDLMSFSGHKIYGPKGIGALYVRRKPRVRIEAQMHGGGHERGMRSGTLPVHQIVGMGEAYRIAKEEMATEMERLRGLRNRLWNGIKDIEEVYLNGDLEHGAPNILNVSFNYVEGESLIMALKDLAVSSGSACTSASLEPSYVLRALGLNDELAHSSIRFSLGRFTTEEEIDYTIELVRKSIGRLRDLSPLWEMYKQGVDLNSIEWAHH

SEQ ID NO: 884 - protein, 128 aa, Escherichia coli str. K-12 substr. MG1655
MAYSEKVIDHYENPRNVGSFDNNDENVGSGMVGAPACGDVMKLQIKVNDEGIIEDARFKTYGCGSAIASSSLVTEWVKGKSLDEAQAIKNTDIAEELELPPVKIHCSILAEDAIKAAIADYKSKREAK

SEQ ID NO: 885 - protein, 107 aa, Escherichia coli str. K-12 substr. MG1655
MSITLSDSAAARVNTFLANRGKGFGLRLGVRTSGCSGMAYVLEFVDEPTPEDIVFEDKGVKVVVDGKSLQFLDGTQLDFVKEGLNEGFKFTNPNVKDECGCGESFHV

SEQ ID NO: 886 - protein, 171 aa, Escherichia coli str. K-12 substr. MG1655
MDYFTLFGLPARYQLDTQALSLRFQDLQRQYHPDKFASGSQAEQLAAVQQSATINQAWQTLRHPLMRAEYLLSLHGFDLASEQHTVRDTAFLMEQLELREELDEIEQAKDEARLESFIKRVKKMFDTRHQLMVEQLDNETWDAAADTVRKLRFLDKLRSSAEQLEEKLLDF

SEQ ID NO: 887 - protein, 616 aa, Escherichia coli str. K-12 substr. MG1655
MALLQISEPGLSAAPHQRRLAAGIDLGTTNSLVATVRSGQAETLADHEGRHLLPSVVHYQQQGHSVGYDARTNAALDTANTISSVKRLMGRSLADIQQRYPHLPYQFQASENGLPMIETAAGLLNPVRVSADILKALAARATEALAGELDGVVITVPAYFDDAQRQGTKDAARLAGLHVLRLLNEPTAAAIAYGLDSGQEGVIAVYDLGGGTFDISILRLSRGVFEVLATGGDSALGGDDFDHLLADYIREQAGIPDRSDNRVQRELLDAAIAAKIALSDADSVTVNVAGWQGEISREQFNELIAPLVKRTLLACRRALKDAGVEADEVLEVVMVGGSTRVPLVRERVGEFFGRPPLTSIDPDKVVAIGAAIQADILVGNKPDSEMLLLDVIPLSLGLETMGGLVEKVIPRNTTIPVARAQDFTTFKDGQTAMSIHVMQGERELVQDCRSLARFALRGIPALPAGGAHIRVTFQVDADGLLSVTAMEKSTGVEASIQVKPSYGLTDSEIASMIKDSMSYAEQDVKARMLAEQKVEAARVLESLHGALAADAALLSAAERQVIDDAAAHLSEVAQGDDVDAIEQAIKNVDKQTQDFAARRMDQSVRRALKGHSVDEV

SEQ ID NO: 888 - protein, 111 aa, Escherichia coli str. K-12 substr. MG1655
MPKIVILPHQDLCPDGAVLEANSGETILDAALRNGIEIEHACEKSCACTTCHCIVREGFDSLPESSEQEDDMLDKAWGLEPESRLSCQARVTDEDLVVEIPRYTINHAREH

SEQ ID NO: 889 - protein, 122 aa, Escherichia coli str. K-12 substr. MG1655
MDMHSGTFNPQDFAWQGLTLTPAAAIHIRELVAKQPGMVGVRLGVKQTGCAGFGYVLDSVSEPDKDDLLFEHDGAKLFVPLQAMPFIDGTEVDFVREGLNQIFKFHNPKAQNECGCGESFGV

SEQ ID NO: 890 - protein, 495 aa, Escherichia coli str. K-12 substr. MG1655
MSRNTEATDDVKTWTGGPLNYKEGFFTQLATDELAKGINEEVVRAISAKRNEPEWMLEFRLNAYRAWLEMEEPHWLKAHYDKLNYQDYSYYSAPSCGNCDDTCASEPGAVQQTGANAFLSKEVEAAFEQLGVPVREGKEVAVDAIFDSVSVATTYREKLAEQGIIFCSFGEAIHDHPELVRKYLGTVVPGNDNFFAALNAAVASDGTFIYVPKGVRCPMELSTYFRINAEKTGQFERTILVADEDSYVSYIEGCSAPVRDSYQLHAAVVEVIIHKNAEVKYSTVQNWFPGDNNTGGILNFVTKRALCEGENSKMSWTQSETGSAITWKYPSCILRGDNSIGEFYSVALTSGHQQADTGTKMIHIGKNTKSTIISKGISAGHSQNSYRGLVKIMPTATNARNFTQCDSMLIGANCGAHTFPYVECRNNSAQLEHEATTSRIGEDQLFYCLQRGISEEDAISMIVNGFCKDVFSELPLEFAVEAQKLLAISLEHSVG

SEQ ID NO: 891 - protein, 248 aa, Escherichia coli str. K-12 substr. MG1655
MLSIKDLHVSVEDKAILRGLSLDVHPGEVHAIMGPNGSGKSTLSATLAGREDYEVTGGTVEFKGKDLLALSPEDRAGEGIFMAFQYPVEIPGVSNQFFLQTALNAVRSYRGQETLDRFDFQDLMEEKIALLKMPEDLLTRSVNVGFSGGEKKRNDILQMAVLEPELCILDESDSGLDIDALKVVADGVNSLRDGKRSFIIVTHYQRILDYIKPDYVHVLYQGRIVKSGDFTLVKQLEEQGYGWLTEQQ

SEQ ID NO: 892 - protein, 423 aa, Escherichia coli str. K-12 substr. MG1655
MAGLPNSSNALQQWHHLFEAEGTKRSPQAQQHLQQLLRTGLPTRKHENWKYTPLEGLINSQFVSIAGEISPQQRDALALTLDSVRLVFVDGRYVPALSDATEGSGYEVSINDDRQGLPDAIQAEVFLHLTESLAQSVTHIAVKRGQRPAKPLLLMHITQGVAGEEVNTAHYRHHLDLAEGAEATVIEHFVSLNDARHFTGARFTINVAANAHLQHIKLAFENPLSHHFAHNDLLLAEDATAFSHSFLLGGAVLRHNTSTQLNGENSTLRINSLAMPVKNEVCDTRTWLEHNKGFCNSRQLHKTIVSDKGRAVFNGLINVAQHAIKTDGQMTNNNLLMGKLAEVDTKPQLEIYADDVKCSHGATVGRIDDEQIFYLRSRGINQQDAQQMIIYAFAAELTEALRDEGLKQQVLARIGQRLPGGAR

SEQ ID NO: 893 - protein, 406 aa, Escherichia coli str. K-12 substr. MG1655
MIFSVDKVRADFPVLSREVNGLPLAYLDSAASAQKPSQVIDAEAEFYRHGYAAVHRGIHTLSAQATEKMENVRKRASLFINARSAEELVFVRGTTEGINLVANSWGNSNVRAGDNIIISQMEHHANIVPWQMLCARVGAELRVIPLNPDGTLQLETLPTLFDEKTRLLAITHVSNVLGTENPLAEMITLAHQHGAKVLVDGAQAVMHHPVDVQALDCDFYVFSGHKLYGPTGIGILYVKEALLQEMPPWEGGGSMIATVSLSEGTTWTKAPWRFEAGTPNTGGIIGLGAALEYVSALGLNNIAEYEQNLMHYALSQLESVPDLTLYGPQNRLGVIAFNLGKHHAYDVGSFLDNYGIAVRTGHHCAMPLMAYYNVPAMCRASLAMYNTHEEVDRLVTGLQRIHRLLG

SEQ ID NO: 894 - DNA, 324 bp, Azotobacter vinelandii DJ
atgattaccctgacagagagcgccaagagcgcggttacccgcttcatcagcagcactggcaagccgatcgccggtttgcgcatccgggtcgagggtggcggttgttccggcctgaaatacagcctgaagctggaagaagccggtgcggaagacgatcaactggtcgactgcgacggcatcaccctgctgatcgacagcgccagcgctcctctgctcgatggcgtgaccatggacttcgtggaaagcatggaaggtagcggtttcaccttcgtcaatccgaatgccaccaacagttgtggttgtggcaagtcttttgcttgttga

SEQ ID NO: 895 - DNA, 1209 bp, Azotobacter vinelandii DJ
atggctgacgtctatctcgataacaacgccaccacccgggtggacgacgaaatcgtccaggccatgctgccgttcttcaccgaacagttcggcaacccctcgtcgctgcacagcttcggcaaccaggtcggcatggcgctgaagaaggcccgccagagcgtgcagaaactgctcggtgccgaacacgattcggaaatcgtcttcacctcctgcggcaccgagtcggactccaccgcgatcctctcggcgctcaaggcccagcccgaacgcaagaccgtcatcaccaccgtggtcgaacacccggccgtcctcagcctgtgcgattacctcgccagtgagggctacaccgtgcacaagctgccggtggacaagaaaggccgtctggatctggagcattacgccagcctgctgaccgacgatgtcgccgtggtgtcggtgatgtgggccaacaacgagaccggtaccctgttcccgatcgaagagatggcgcgcctggccgacgacgccggcatcatgtttcacaccgatgccgtgcaggccgtgggcaaggtaccgatcgacctgaagaattcgtcgatccacatgctttcgctgtcgggccacaagctgcacgcgcccaaaggtgtcggcgtgctctatctgcgccgcggcacccgcttccgtccgctgctgcgcggtggtcaccaggagcgcggccgtcgtgccggcaccgagaacgccgcctccatcatcggcctgggtgtcgccgccgaacgcgcgctgcagttcatggagcacgagaacaccgaggtcaagcgcctgcgcgacaagctggaggccggtatcctcgccgtcgtgccccatgccttcgtcaccggcgatccggacaaccgcttgcccaacaccgccaacatcgcgttcgagtacatcgagggcgaggccatcctgctgctgctgaacaaggtcggcatcgccgcctccagcggttcggcctgcacctccggctccttggagccctcccacgtgatgcgcgccatggacattccctatactgccgcccacggcaccgtgcgcttctccctgtcgcgctacaccaccgaggaggagatcgaccgggtgatccgcgaggttccgccgatcgtggcccagttgcgcaagctgtcgccctactggagcggcaacggtccggtggaggacccgggcaaggccttcgctccggtctacggctga

SEQ ID NO: 896 - DNA, 939 bp, Azotobacter vinelandii DJ
atgtgggattattcggaaaaagtcaaagagcacttctacaaccccaagaatgctggagccgtggaaggcgccaacgccatcggcgacgtcggatcgctgagttgcggtgatgcgctgcgcctgaccctgaaggtggacccggaaaccgacgtgattctggatgccggcttccagaccttcggctgtggttccgccatcgcttcctcctcggcgctgaccgagatggtcaagggcctgaccctggacgaggcgctgaagatcagtaaccaggacatcgccgactacctcgatggcctgccgccggagaagatgcactgctcggtgatgggccgcgaagccctgcaggccgcggtggccaactaccgtggcgagacgatcgaggacgaccacgaagagggcgcgctgatctgcaagtgcttcgccgtcgacgaggtgatggtccgcgataccatccgtgccaacaagctgtctaccgttgaggacgtgaccaattacaccaaggccggcggtggctgctccgcctgccacgaggctatcgagcgcgtgctgaccgaagagctggccgctcgcggtgaagtcttcgtcgcggccccgataaaggccaagaagaaggtcaaggtgctcgcccccgagccggctcccgccccggtggccgaagccccggcggctgccccgaagctgagcaacctgcagcgcatccgtcgcatcgagaccgtgctggcggcgatccgtccgaccttgcagcgcgacaagggcgacgtcgaactgatcgatgtcgacggcaagaacgtttatgtcaagctcaccggcgcctgcaccggctgccagatggccagcatgaccctcggcggcatccagcagcgcctgatcgaggagctcggcgagttcgtcaaggtgattccggtcagcgctgcggctcacgcgcagatggaggtctga

SEQ ID NO: 897 - DNA, 798 bp, Azotobacter vinelandii DJ
atgagtctgcttacgcaatggcgtgatgacatccgctgcgtcttcgagcgcgacccggcggcacgcaccaccttcgaggtgctcaccacctatccgggggtgcacgcgatcatcggctaccggctggccaatcgcctgtggcgtgccggctggcgctatccggcacgtctgctgtcgttcgtcgcccgcatgctgagcaacgtggacattcacccgggggcgaccatcggcgagcgtttcttcatcgatcacggcgcctgcgtggtgatcggcgaaaccgccgagatcggcaacgacgtgaccctctaccatggcgtgactctcggcggcaccagttggaacaagggcaagcgccatccgacgctgagggacggcgtgctggtgggcgcgggagccaagattctcggtcccatcaccgtgggcgcgggcgcccgggtgggggccaactccgtggtggtccaggatgtgccggacggttgcaccgtggtcggcatccccggcaaggtagtcaaggtgcgcgaggccggccgcccgaatccctatggcatcgacctcgaccatcacctgattccggacccggtgggcaaggccatcgcctgcctgctggagcgcatcgatgcgctggagaagcaggtcgaggcgggtgggctggtcaccgtcggcagccagcagcagttctaccaggtctgtaactccgacaacagcatttgcgagagcgactgcgccggtggcaccactgcgcaggctcaacaatcggccggtcgccgtcgggccgtacccactccggtggccgagtga

SEQ ID NO: 898 - DNA, 351 bp, Azotobacter vinelandii DJ
atgaccgtcgaaaccttcaccccgactccgctgctctttacgcagggggccgcaaacaaggtgaagactctgatcagcgaggaaggcaatccgcgtctgaagctccgtgtttttgtcacgggcgggggatgctcgggtttccagtatggattcaccttcgatgaagatgtcgccgaagacgacaccatcgtcgagcgtgaaggtgtcagcttggtcgtcgaccccatgagtttccagtacctggccggggccgaggtcgattatcaggaagggctggaaggttcacgcttcgtgatcaagaacccgaatgccgcaaccacttgtggctgcggccagtctttctcggtctga

SEQ ID NO: 899 - DNA, 585 bp, Azotobacter vinelandii DJ
atgagcgccatcaccataaccgacgccgcacacgactatctggccgaattgctggccaagcagaacggcaccgacatcggtatccgtatcttcatcacccagcccggtacgcccgccgccgagacctgtctcgcctactgcaagccgcacgagcggcatccggacgacatcgcccaggcgctgaagagcttcaccctgtggatcgatgccgtcagcgaaccctttctcgaggacgccatcgtcgactacgccaacgatcgcatgggcgggcaactgaccatcaaggcaccgaacgccaaggtgccgatgatcgacgaggacagtccgctgggcgaacggatcaactactacctgcagaccgagatcaatccgggtctggccagccatggcggccaggtgagcctggtggacatcgtcgaggagggaatcgccgtgctgcgtttcggtggcggttgccagggatgcggcatggtcgacatgacgttgaaggacggcgtggagaagaccctgctcgagcgcatccccgacctcaagggcgtgcgcgacgccaccgatcacagcaaccgggaaaacgcctactactga

SEQ ID NO: 900 - DNA, 291 bp, Azotobacter vinelandii DJ
atgaacacccagcccgacctcgaacgctccgccgcaaagcctctgacggaagagcaacgcagcagcatcatcaccgaaaccatcgagcggctgcgccccggcctccaggccgacggcggcgacatggagatcgtctccatcgacggctacaaggtgcgtttgcgcctgaaaggcatgtgcgccggctgtaccgcctcgggagaaaccctgggcggcatccgtcggcaactgatgctggccctgggtgaaaacgaacccatcctggtactgcccgaactgccgccgctctga

SEQ ID NO: 901 - DNA, 291 bp, Azotobacter vinelandii DJ
atgtccaatccgccgctggataccgaggaaaacgcaaccaccctcgcgataacgcccatccccgccgaatccctgccgctggtgcgcgaaaccgtcgagcgcctgcgcccgggcgtgcagcgcgacggtggcgacctggagctggtcgccgtacaggacaacatcgtccgcctgcgcctcaagggcgcctgcgtcggctgcgccatgtccgcccagacgctcggcggcgtgcgccgcgaactggtcaaggtgctcgacaatccctcggtgcgcgtactgccggccccctga

SEQ ID NO: 902 - DNA, 1164 bp, Helicobacter pylori B38
ttgttacaacgaatttatttagacaataacgctacaactaggattgaccctaaagtcaaggagatcatggatccttttttaagggatcattatgggaatcctagctcgttgcaccagtttggcacagaaacccacccagccattgcagaagcattggataagctttataaaggcattaacgctagggatatagacgatgtgatcatcacttcttgcgcgacagagagcaataattgggttttaaagggcgtgtattttgatgaatgcttgaaaaaaggcaaaaaccatattgtaaccacggttgcagagcatccggcggtgcgatccacttgtaattttttagaaagcttgggggtggaggttacttacttgcccattaatgagcatgggagtatcaccgcagagcaagtcaaagaagcgatcacagaaaaaaccgctctagtgagcgtgatgtgggcgaataatgaaaccggtctcattttccctattgaagaaattggggctatctgtaaagaaaagggcgtgttgttccataccgatgcggtgcaagcgattggtaaaatccctgtagatgtgttaaaagcgaatgcagattttctttcttttagcgcgcacaaattccatgggcctaaaggcattgggggtttatacattagaagtggggtgggattgacccctctttttcatggcggggagcatatgaatggcaggcgcagcgggactttgaatgtgccttatattgtgggaatgggcgaagcgatgagattagccgtagagcatttagactatgaaaaagaagtggtagggaaattgcgcgacaaattagaagaagcgcttttgaaaatccctgatgtgatggtggtaggggatcgaatccatcgtgtgcctaacacgactttagtcagcgtgagagggattgaaggagaggccatgctgtgggatttgaatcgctctaatatcgccgcttccacagggagcgcgtgcgcgagtgaagatttagaggctaatcctgtcatggtagcgattggagcgagcaaggaattagctcataccgctatcaggctttcattgagccgttttaacacggaagctgaaattgacaaaacgattgaagttttctctcaagcggctgtaaggttgagaaatatttcaagctcttattaa

SEQ ID NO: 903 - DNA, 981 bp, Helicobacter pylori B38
atggcaaaacatgatttagtgggttcggttctctgggatgcgtattctaaagaagttcaaaggcgcatggataaccctacgaatttaggggtcatcaccgaagagcaggctaaagccaaaaacgctaagctcattgtggcggattatggcgcagaggcatgcggtgatgcggtgaggttgtattggcttgtagatgaaagcacggatacgattattgacgcgaagtttaaaagctttggttgcgggacagcgatcgcaagctcagacatgatggtagagttgtgtttgaataaaagagtccaagatgcggtaaaaatcacgaatttagatgtggaaagaggcttgagagacgatccggacacgccggctgtccctgggcaaaaaatgcactgctcggtgatggcgtatgatgtgatcaaaaaagctgccggcatgtatttggggaaaaacgccgaagattttgaagaagaaatcatcgtgtgcgagtgcgctagggtgagtttaggcacgattaaggaagtgattaggctcaatgatttaaaaagcgttgaagaaatcactaattacaccaaagccggcgcgttttgtaaaagctgcgtgaggcccggagggcatgaaaaaagggattattacctggtggatattcttaaagaagtgcgcgaagaaatggaagctgaaaaacttaaagccgctgcgaataaatcccaaagtggggaattggcttttagggaaatgactatggttcaaaagattaaagccgtggataaagtcattgatgaaaatatccgcccgatgcttatgatggacggaggggatttagagattttagacattaaagaaagcgatgattacattgatgtgtatatccgctacatgggggcatgcgatgggtgcatgagcgcgactaccgggactttatttgccattgaaaacgctttgcaggaattattggatcgcagtatcagggtgttaccgatttga

SEQ ID NO: 904 - DNA, 1215 bp, Escherichia coli str. K-12 substr. MG1655
atgaaattaccgatttatctcgactactccgcaaccacgccggtggacccgcgtgttgccgagaaaatgatgcagtttatgacgatggacggaacctttggtaacccggcctcccgttctcaccgtttcggctggcaggctgaagaagcggtagatatcgcccgtaatcagattgccgatctggtcggcgctgatccgcgtgaaatcgtctttacctctggtgcaaccgaatctgacaacctggcgatcaaaggtgcagccaacttttatcagaaaaaaggcaagcacatcatcaccagcaaaaccgaacacaaagcggtactggatacctgccgtcagctggagcgcgaaggttttgaagtcacctacctggcaccgcagcgtaacggcattatcgacctgaaagaacttgaagcagcgatgcgtgacgacaccatcctcgtgtccatcatgcacgtaaataacgaaatcggcgtggtgcaggatatcgcggctatcggcgaaatgtgccgtgctcgtggcattatctatcacgttgatgcaacccagagcgtgggtaaactgcctatcgacctgagccagttgaaagttgacctgatgtctttctccggtcacaaaatctatggcccgaaaggtatcggtgcgctgtatgtacgtcgtaaaccgcgcgtacgcatcgaagcgcaaatgcacggcggcggtcacgagcgcggtatgcgttccggcactctgcctgttcaccagatcgtcggaatgggcgaggcctatcgcatcgcaaaagaagagatggcgaccgagatggaacgtctgcgcggcctgcgtaaccgtctgtggaacggcatcaaagatatcgaagaagtttacctgaacggtgacctggaacacggtgcgccgaacattctcaacgtcagcttcaactacgttgaaggtgagtcgctgattatggcgctgaaagacctcgcagtttcttcaggttccgcctgtacgtcagcaagcctcgaaccgtcctacgtgctgcgcgcgctggggctgaacgacgagctggcacatagctctatccgtttctctttaggtcgttttactactgaagaagagatcgactacaccatcgagttagttcgtaaatccatcggtcgtctgcgtgacctttctccgctgtgggaaatgtacaagcagggcgtggatctgaacagcatcgaatgggctcatcattaa

SEQ ID NO: 905 - DNA, 387 bp, Escherichia coli str. K-12 substr. MG1655
atggcttacagcgaaaaagttatcgaccattacgagaatccgcgtaacgtgggttcctttgacaacaacgacgagaacgtcggcagcggcatggtgggggcaccggcctgtggcgacgtgatgaagttgcagattaaagtcaacgatgaaggtatcattgaagacgcgcgttttaaaacttacggctgcggttccgctatcgcttccagctccctggtcaccgaatgggtgaaagggaagtctctcgacgaagcgcaggcgatcaaaaacaccgatattgctgaagaacttgaactgccgccggtgaaaattcactgttctattctggcagaagacgcgatcaaagccgccattgcggactataaaagcaaacgtgaagcaaaataa

SEQ ID NO: 906 - DNA, 324 bp, Escherichia coli str. K-12 substr. MG1655
atgtcgattacactgagcgacagtgcagcagcgcgagtaaatacctttctggctaaccgcggtaaagggtttggcctgcgtctgggcgtgagaacctccgggtgttcaggtatggcttatgtactggaatttgttgacgaaccgacgccggaagacatcgtgtttgaagacaaaggcgtgaaagtcgtggtcgatggcaagagcctgcaatttctggacggtacgcagctggacttcgtaaaagaaggcctgaacgaagggtttaaattcaccaacccgaacgtcaaagatgagtgtggttgcggcgaaagcttccacgtttga

SEQ ID NO: 907 - DNA, 516 bp, Escherichia coli str. K-12 substr. MG1655
atggattacttcaccctctttggcttgcctgcccgctatcaactcgatacccaggcgctgagcctgcgttttcaggatctacaacgtcagtatcatcctgataaattcgccagcggaagccaggcggaacaactcgccgccgtacagcaatctgcaaccattaaccaggcctggcaaacgctgcgtcatccgttaatgcgcgcggaatatttgctttctttgcacggctttgatctcgccagcgagcagcatactgtgcgcgacaccgcgttcctgatggaacagttggagctgcgcgaagagctggacgagatcgaacaggcgaaagatgaagcgcggctggaaagctttatcaaacgtgtgaaaaagatgtttgatacccgccatcagttgatggttgaacagttagacaacgagacgtgggacgcggcggcggataccgtgcgtaagctgcgttttctcgataaactgcgaagcagtgccgaacaactcgaagaaaaactgctcgatttttaa

SEQ ID NO: 908 - DNA, 1851 bp, Escherichia coli str. K-12 substr. MG1655
atggccttattacaaattagtgaacctggtttgagtgctgcgccgcatcagcgtcgtctggcggccggtattgacctgggcacaaccaactcgctggtggcgacagtgcgcagcggtcaggccgaaacgttagccgatcatgaaggccgtcacctgctgccatctgttgttcactatcaacagcaagggcattcggtgggttatgacgcgcgtactaatgcagcgctcgataccgccaacacaattagttctgttaaacgcctgatgggacgctcgctggctgatatccagcaacgctatccgcatctgccttatcaattccaggccagcgaaaacggcctgccgatgattgaaacggcggcggggctgctgaacccggtgcgcgtttctgcggacatcctcaaagcactggcggcgcgggcaactgaagccctggcaggcgagctggatggtgtagttatcaccgttccggcgtactttgacgatgcccagcgtcagggcaccaaagacgcggcgcgtctggcgggccttcacgtcctgcgcttacttaacgaaccgaccgctgcggctatcgcctacgggctggattccggtcaggaaggcgtgatcgccgtttatgacctcggtggcgggacgtttgatatttccattctgcgcttaagtcgcggcgtgtttgaagtgctggcaaccggcggtgattccgcgctcggcggcgatgatttcgaccatctgctggcggattacattcgcgagcaggcgggcattcctgatcgtagcgataaccgcgttcagcgtgaactgctggatgccgccattgcagccaaaatcgcgctgagcgatgcggactccgtgaccgttaacgttgcgggctggcagggcgaaatcagccgtgaacaattcaatgaactgatcgcgccactggtaaaacgaaccttactggcttgtcgtcgcgcgctgaaagacgcgggtgtagaagctgatgaagtgctggaagtggtgatggtgggcggttctactcgcgtgccgctggtgcgtgaacgggtaggcgaatttttcggtcgtccaccgctgacttccatcgacccggataaagtcgtcgctattggcgcggcgattcaggcggatattctggtgggtaacaagccagacagcgaaatgctgttgcttgatgtgatcccactgtcgctgggcctcgaaacgatgggcggcctggtggagaaagtgattccgcgtaataccactattccggtggcccgcgctcaggatttcaccacctttaaagatggtcagacggcgatgtctatccatgtaatgcagggtgagcgcgaactggtgcaggactgccgctcactggcgcgttttgcgctgcgtggtattccggcgctaccggctggcggtgcgcatattcgcgtgacgttccaggtcgatgccgacggtcttttgagcgtgacggcgatggagaaatccaccggcgttgaggcgtctattcaggtcaaaccgtcttacggtctgaccgatagcgaaatcgcttcgatgatcaaagactcaatgagctatgccgagcaggacgtaaaagcccgaatgctggcagaacaaaaagtagaagcggcgcgtgtgctggaaagtctgcacggcgcgctggctgctgatgccgcgctgttaagcgccgcagaacgtcaggtcattgacgatgctgccgctcacctgagtgaagtggcgcagggcgatgatgttgacgccatcgaacaagcgattaaaaacgtagacaaacaaacccaggatttcgccgctcgccgcatggaccagtcggttcgtcgtgcgctgaaaggccattccgtggacgaggtttaa

SEQ ID NO: 909 - DNA, 336 bp, Escherichia coli str. K-12 substr. MG1655
atgccaaagattgttattttgcctcatcaggatctctgccctgatggcgctgttctggaagctaatagcggtgaaaccattctcgacgcagctctgcgtaacggtatcgagattgaacacgcctgtgaaaaatcctgtgcttgcaccacctgccactgcatcgttcgtgaaggttttgactcactgccggaaagctcagagcaggaagacgacatgctggacaaagcctggggactggagccggaaagccgtttaagctgccaggcgcgcgttaccgacgaagatttagtagtcgaaatcccgcgttacactatcaaccatgcgcgtgagcattaa

SEQ ID NO: 910 - DNA, 369 bp, Escherichia coli str. K-12 substr. MG1655
atggacatgcattcaggaacctttaacccacaagatttcgcctggcaaggcttaacgctgacacccgcagcggcgatacacatccgtgagctggtggcaaagcagccgggtatggtcggcgtgcgcttaggcgtgaagcaaacgggctgcgcgggctttggctatgtgctcgacagtgttagcgagccggacaaagacgatctgctgtttgaacacgacggcgcgaagctgtttgtcccgctgcaagcgatgccgtttattgatggcacggaagtcgatttcgttcgtgaaggacttaatcagatattcaaatttcacaaccctaaagcccagaatgaatgtggctgtggcgaaagctttggggtatag

SEQ ID NO: 911 - DNA, 1488 bp, Escherichia coli str. K-12 substr. MG1655
atgtctcgtaatactgaagcaactgacgatgtcaaaacctggaccggcggcccgctgaattataaagaaggattcttcacccagttagccaccgatgagctggcaaaggggataaacgaagaggtggtgcgcgcaatttcggcgaagcgtaatgagccggagtggatgctggagtttcgtctaaacgcctatcgcgcatggctggagatggaagaaccgcactggttgaaagcgcactacgacaagctgaattatcaggattacagctactactcagcaccatcgtgcggtaattgtgacgacacttgcgcgtctgaacctggcgcggtgcagcaaactggcgcgaacgcctttttaagtaaagaggtggaggcggcgtttgagcagttgggcgttcccgtgcgggaaggcaaagaggtggcggtggatgccattttcgactcagtttcggttgccactacttatcgcgaaaaactggcggagcagggaattattttctgttcctttggtgaggcgatccacgatcacccggaactggtgcgtaaatatctcggcaccgtggtgccggggaatgacaacttctttgccgcgcttaatgcggcggtagcctctgatggtacgtttatttatgtgcctaaaggcgtgcgctgcccgatggaactttccacctattttcgcattaacgcagaaaaaaccgggcagtttgagcgcaccattctggtggccgacgaagacagctacgtcagctacattgaaggctgttccgctccggtgcgtgacagctatcagttacacgcggcagtggtggaagtcatcatccataaaaacgccgaggtgaaatattccacggtacaaaactggtttcctggcgataacaacaccggcggtattctcaacttcgtcaccaagcgtgctttgtgcgaaggcgaaaacagcaaaatgtcatggacgcaatcagaaaccgggtcagcgattacgtggaaatatcccagctgcattttgcgcggcgataactccattggtgagttttactcagtggcgctgaccagcggtcatcagcaagcggataccggcaccaagatgatccacatcggtaaaaacaccaaatcgaccattatctcgaaagggatctctgccggacatagtcagaacagttatcgcggcttagtgaaaatcatgccgacggcaaccaatgcgcgcaatttcactcagtgcgactcaatgctgattggcgctaattgtggggcgcataccttcccgtatgttgagtgtcgtaacaatagtgcgcaactggaacacgaggcaacgacatcacgtattggtgaagatcaactgttttactgcctgcaacgcgggatcagcgaagaagacgccatctcgatgattgttaacggtttctgcaaagacgtgttctcggagctgccgttggaatttgccgttgaagcacaaaaactcctcgccatcagtcttgaacacagcgtcggataa

SEQ ID NO: 912 - DNA, 747 bp, Escherichia coli str. K-12 substr. MG1655
atgttaagtattaaagatttacacgtcagcgtggaagataaagctatcctgcgcggattaagcctcgacgttcatcccggcgaagttcacgccattatggggccaaacggttcgggcaaaagtaccttatcggcaacgcttgccgggcgagaagattatgaagtgacgggcggcacggttgagttcaaaggcaaagatttgcttgcgctgtcgccggaagatcgcgcgggcgaaggcatctttatggccttccagtatccggtggagattccaggtgtcagtaaccagtttttcctgcaaacggcacttaatgcggtgcgcagctatcgcggccaggaaacgctcgaccgctttgattttcaggatttgatggaagagaaaatcgctctcctgaagatgccggaagatttattaacccgttcggtaaacgttggtttttccggcggcgagaaaaagcgcaacgatattttgcaaatggcggtgctggaaccggagttatgcattcttgatgagtcggactccgggctggatattgacgcattaaaagtggtcgccgatggcgtgaactcgctgcgtgatggcaagcgctcattcatcattgttacgcactaccaacgcattctcgactacatcaagcctgattacgttcatgtgctatatcagggacgaattgtgaaatccggcgatttcacgttggtcaaacaactggaggagcagggttatggctggcttaccgaacagcagtaa

SEQ ID NO: 913 - DNA, 1272 bp, Escherichia coli str. K-12 substr. MG1655
atggctggcttaccgaacagcagtaacgcgctgcaacagtggcatcacttgtttgaagctgaagggacaaaacgctccccgcaagcacagcagcatttacaacaattgctgcgtaccggactgccgacacgtaaacatgaaaactggaaatatacgccgctggaagggctgatcaatagccagtttgtcagcattgcgggagagatatccccacagcagcgtgatgccttagcgttaacgttagactccgtgcggctggtgtttgtcgatgggcgttacgtgcccgcactgagcgatgcaactgaaggcagcggatatgaagtgagcattaacgacgaccgtcagggtttacccgacgctattcaggcggaagtgtttctgcatttgacggaaagcctggcacaaagcgtgacgcatatcgccgtgaagcgcggtcaacggccggcaaagccattgctgttaatgcatatcacccagggcgtggcaggtgaagaggtgaacactgcccattaccgacatcatctggatctggcggaaggtgccgaagcaacggtgatcgaacattttgtcagcctgaatgatgctcgtcattttaccggggcacggttcactatcaacgtcgcagcgaatgcccacttgcagcatatcaagctggcgtttgaaaacccgctcagtcaccactttgctcataacgatttgttgctggctgaggatgccaccgcatttagccacagtttcctgctgggtggcgcagtgttacgacacaacaccagtacgcaactcaatggcgaaaacagcacgctgcggatcaatagcctggcgatgccggtgaaaaacgaggtgtgtgatacccgtacctggctggaacacaataaaggtttttgtaacagccgacagttgcacaaaactatcgtcagcgacaaaggccgcgcggtatttaacggtttgatcaacgtcgcgcagcacgccatcaaaacggatggtcagatgaccaacaacaatctgctgatgggcaaactggcggaagtggatacgaaaccgcagctggaaatctatgcagatgatgtgaaatgcagccacggcgcgacggtggggcgtattgatgatgaacagatattctatctgcgctcgcgcgggatcaatcagcaggatgcccagcagatgatcatttacgccttcgctgccgaactgacggaagcactgcgtgatgaggggcttaaacagcaggtgctggcccgaatcggtcaacggctgccaggaggtgcaagatga

SEQ ID NO: 914 - DNA, 1221 bp, Escherichia coli str. K-12 substr. MG1655
atgattttttccgtcgacaaagtgcgggccgactttccggtgctttcgcgtgaggtaaacggtttgccgctggcttatctcgacagcgccgccagtgcgcagaaaccgagccaggtgattgacgccgaggccgagttttatcgtcatggctacgcggcggtgcatcgtggtattcataccttaagcgcccaggcgaccgagaaaatggagaacgtgcgcaagcgggcatcgctgtttattaatgcccgttcggcggaagagctggtgttcgtccgcggcacgacggaagggatcaatctggtcgccaatagctggggcaacagcaacgtgcgggcgggcgataacatcatcatcagtcagatggagcaccacgctaacattgttccctggcagatgctttgcgcacgcgttggcgcagagctgcgtgtgatcccgctcaatcccgatggtacgttgcaactggagacgctgcctacgctgtttgatgagaaaactcgcctgctggcaattactcatgtctccaacgtgcttggcacagaaaatccactggcggaaatgatcacgcttgcgcaccagcatggcgcaaaagtgctggtggatggcgctcaggcggtgatgcatcatccggtggatgttcaggcgctggattgcgacttttacgtgttctccgggcataaactgtatggccccaccggaattggcattctttatgtgaaagaagccttgttgcaggagatgccgccgtgggaagggggcggttctatgatcgccaccgtcagcctgagtgaaggcactacctggaccaaagcaccatggcggtttgaagccggtacacccaataccgggggcatcattggtcttggcgcggcgctggagtatgtttcggcgctggggcttaataacatagccgagtatgaacagaatctgatgcattatgcgctatcacagctggaatctgtaccggatctcactctctatggcccacaaaacaggcttggcgttattgcttttaatctcggtaaacaccacgcctatgatgttggcagttttctcgataattacggcattgctgtgcgtaccggacatcactgcgcaatgccattgatggcctattacaacgtccctgcgatgtgtcgggcgtcgctggccatgtataacacccatgaagaagtggatcgtctggtgaccggcctgcaacgtattcaccgtttgctgggataa

SEQ ID NO: 915 - DNA, 42 bp, Artificial sequence
  primer
acgctagcactggtagagagcgactttgtatgccccaattgc

SEQ ID NO: 916 - DNA, 46 bp, Artificial sequence
  primer
accgcggtggtttaacgtatagacttctaatatatttctccatact

SEQ ID NO: 917 - DNA, 11382 bp, Artificial sequence
  construct
ggtggagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagcactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgc

SEQ ID NO: 918 - DNA, 8354 bp, Artificial sequence
  construct
tgcaaggcgattaagttgggtaacgccagggttttcccagtcacgacgttgtaaaacgacggccagtgaattgtaatacgactcactatagggcgaattgggcccgacgtcgtcgactgttggaatagaaatcaactatcatctactaactagtatttacattactagtatattatcatatacggtgttagaagatgacgcaaatgatgagaaatagtcatctaaattagtggaagctgaaacgcaaggattgataatgtaataggacccgggtttaacgtatagacttctaatatatttctccatacttggtattttttattcactttttttatacatatttggtttttttatacaatatcaaaaatcaataataattaatttaataacaagaatatgttgctgtgatgactcttaatatacaattgggaagcattcaaggattggtacgacgtttgctttctgataattaaacgcttggcgtttaatcttttttgccgattaataatattattattaccctcttatttattagcattgtcttccgtactaaaaggagtagggaaaaaggcgaagtagagtgacacgtccattacccagcgcttcataagaatccatcaggtatattaaattgtgatgggagaacaaaacaaattgtactatgatgtcgagaaattggtgaattctttgcaggaaagttttgacctggattgcgcgcaaagtgtatcacttttcaccagtaaatcaaggagcaatgaggcttggttggaagagctagagaataaattcaagttaaaagatgatgttgaacttgatgatgtggaaaatttaagagccgaaattgacatgaagttaaatatgttggaggataaagtaagctactatgaaagactttacaaagaactcgaagagttccagaatgaaataaaaattaaaacagttgtgaataacagaagacaatcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactagtttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcaattatttagtactgtcagtattgttattcatttcttagggcttgcgtcagcttgatgaggatttgtgatagtagccgttggaggcatgaagggcattggaaacatggggaaaggaggtataccgaaaggtaacggtactggtggcactggcgtaccgccgttatttacagaagttggaaggctggtattgttgttcaagccagcggtgccagttggatccatcaacttcattttcttagtttctggctggttgccatctttagagcttccgtgtagttcctcttgtttcttcaaaaacgtttcgacctccttttccttgtcctggtcgggtactaaagaatcgagaaggatatcgcgggtttcgcaattggggcatacaaagtcgctctctaccagtccgcgggctagcgctgcattttttttttttttttttttttttttttttatatatatttcaaggatataccattgtaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgttccacttccagatgaggcgctggaagcctccaagaaggctgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgttagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaagttcaacatcaattgattgattctgccgccatgatcctagttaagaacccaacccacctaaatggtattataatcaccagcaacatgtttggtgatatcatctccgatgaagcctccgttatcccaggctccttgggtttgttgccatctgcgtccttggcctctttgccagacaagaacaccgcatttggtttgtacgaaccatgccatggttccgctccagatttgccaaagaataaggtcaaccctatcgccactatcttgtctgctgcaatgatgttgaaattgtcattgaacttgcctgaagaaggtaaagccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacaaaaaaaaaaaaaaaaaaaaaaaaaaaaaaaaaaaaaaaaaaaaaaaaaaaatgcagcgtcacatcggataataatgatggcagccattgtagaagtgccttttgcatttctagtctctttctcggtctagctagttttactacatcgcgaagatagaatcttagatcacactgcctttgctgagctggatcaatagagtaacaaaagagtggtaaggcctcgttaaaggacaaggacctgagcggaagtgtatcgtacagtagacggagtatactagagtcgacctgcaggcatgcaagcttttcaattcatcattttttttttattcttttttttgatttcggtttccttgaaatttttttgattcggtctagcgccggctcaatgaatataaacatataaaatgatgataataatatttatagaattgtgtagaattgcagattccattttgaggattcctatatcctcgaggagaacttctagtatattctgtatacctaatattatagcctttatcaacaatggaatcccaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgc

SEQ ID NO: 919 - DNA, 5407 bp, Artificial sequence
  vector
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatagccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccatacaatgccatctcatttcgatactgttcaactacacgccggccaagagaaccctggtgacaatgctcacagatccagagctgtaccaatttacgccaccacttcttatgttttcgaaaactctaagcatggttcgcaattgtttggtctagaagttccaggttacgtctattcccgtttccaaaacccaaccagtaatgttttggaagaaagaattgctgctttagaaggtggtgctgctgctttggctgtttcctccggtcaagccgctcaaacccttgccatccaaggtttggcacacactggtgacaacatcgtttccacttcttacttatacggtggtacttataaccagttcaaaatctcgttcaaaagatttggtatcgaggctagatttgttgaaggtgacaatccagaagaattcgaaaaggtctttgatgaaagaaccaaggctgtttatttggaaaccattggtaatccaaagtacaatgttccggattttgaaaaaattgttgcaattgctcacaaacacggtattccagttgtcgttgacaacacatttggtgccggtggttacttctgtcagccaattaaatacggtgctgatattgtaacacattctgctaccaaatggattggtggtcatggtactactatcggtggtattattgttgactctggtaagttcccatggaaggactacccagaaaagttccctcaattctctcaacctgccgaaggatatcacggtactatctacaatgaagcctacggtaacttggcatacatcgttcatgttagaactgaactattaagagatttgggtccattgatgaacccatttgcctctttcttgctactacaaggtgttgaaacattatctttgagagctgaaagacacggtgaaaatgcattgaagttagccaaatggttagaacaatccccatacgtatcttgggtttcataccctggtttagcatctcattctcatcatgaaaatgctaagaagtatctatctaacggtttcggtggtgtcttatctttcggtgtaaaagacttaccaaatgccgacaaggaaactgacccattcaaactttctggtgctcaagttgttgacaatttaaagcttgcctctaacttggccaatgttggtgatgccaagaccttagtcattgctccatacttcactacccacaaacaattaaatgacaaagaaaagttggcatctggtgttaccaaggacttaattcgtgtctctgttggtatcgaatttattgatgacattattgcagacttccagcaatcttttgaaactgttttcgctggccaaaaaccatgagtgtgcgtaatgagttgtaaaattatgtataaacctactttctctcacaagttatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccactagttctagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 920 - DNA, 8984 bp, Artificial sequence
  construct
gacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctcagagtacaacgatcaccgcctgcccaaacgagctaagaaatagtacacagggcaaggtcattaaatagcgtatataatcatttaatatagtatgttctcgaagctgatcgcgtaaggcgcagagcgaactaaaaaaaataccggcacccatgcacctcacaccgccgcacgcgagtgaggttgaactgcacccggaaaatgccaagtagatgagtcgtgaagagttctcgttattcgagctagtgagagcctgagaagggcttgccgagtgaactggtgtcacattggccgttttaacgcaagttggcgtacttatattgactgttggatgaaagggtaatcaagagaaacggaaacggcctcctcatcgttaagctcatcagtattcatttctcccctttctgctccatcgcgtgctcgagactatattcttcagattatcaagcagaaacagaattcgcatattacataactttcacaggttgaagtataaaccgctacagtacacaacctcggatagaatatagggaagaggccaattccgtgaaaacgatttaatattctttacagttacaaaaagtattacctattatcctcttttcggtgtcattgacaaacctcttagcgacagaaactccctagcaaaagagtaaatccataggaacaacaaaagaagacaaattatcataatataattgggagtgatagacgacgattcatgctataccgtaggtttttgatacaagtctaacagttatactatttttaaaaacaaaaaaataacagaaaaatctacgacaatggaaggcttcaatccggctgacatagaacatgcgtcaccgattaattcatctgacagccattcatcctcctttgtatatgctctacccaaaagtgctagtgaatatgtagtcaaccataatgagggtcgtgcaagtgcaagtggaaatccagccgcagtgccgtctcccataatgacactgaatctcaaaagcacacattccctcaatattgatcagcatgttcatacctcaacatcgccgacggaaactattgggcatattcatcatgtggaaaagctgaatcaaaacaatttgattcatctggatccagtacccaactttgaagataagtccgatattaagccttggttgcaaaagattttttatcctcaaggaatagaacttgtgatagaaaggtcggacgcatttaaagttgtcttcaagtgtaaagctgctaaaaggggaaggaacgcgagaaggaaaagaaaagataagcccaaaggacaggaccacgaagacgagaaatccaagatcaatgatgacgaattagaatatgcgagtccttctaatgccacagtaaccaatgggcctcaaacatcgcccgatcaaacatcctccataaagccaaagaaaaaaagatgtgtatcgaggtttaataactgtccgtttagagtacgagctacttattcgttaaagaggaaaagatggagcattgttgtaatggacaataaccattcacatcagctaaagtttaaccctgattccgaagagtacaaaaaattcaaagaaaaattaagaaaggataatgacgtagatgcaatcaagaaattcgacgaattggaatacagaactttggccaatttgcccattccaacagctacaatcccctgtgattgtggtttaacaaatgaaatacaaagtttcaatgtcgtattgcccactaacagtaatgttacttcatcagcatcctcttcaactgtatcgtccatatcccttgattcatcgaatgcatctaaaaggccatgcttaccctctgtaaataacaccggtagtatcaataccaataacgtaaggaaaccgaaaagccagtgtaagaataaagacacactcttaaaaagaaccaccatgcagaactttctcacaactaaatcaaggctgcgtaagaccggtacgccaacatcttcgcaacactcatctacagcattttcaggatatattgatgatcctttcaatttgaatgaaatcttgccactgccggcatccgatttcaagctaaacactgtaacaaatttgaacgaaattgactttacgaacatttttaccaaatcgccgcatccacatagcgggtctacccatccaagacaagtcttcgaccaattggacgattgttcctctatactcttctctccattaactacaaacacgaataatgaatttgaaggagagtcagatgattttgttcattctccatatttgaactcagaggcagatttcagccaaattcttagtagtgctcccccagtccatcatgacccaaatgaaacacatcaggaaaaccaggatattattgatagatttgctaatagttcccaagaacataatgagtatattctacaatatttgacgcactccgatgctgctaaccacaataacatcggcgttccaaacaacaattcacattcgctaaatactcagcataacgtttctgatctgggcaactcacttttaagacaagaagctttagttggcagctcttcaacaaaaatcttcgacgaattgaaatttgtacaaaatggcccacacggttctcaacatcctatagattttcaacatgttgaccatcgtcatctcagctctaatgaacctcaagtacgatcacatcaatatggtccgcaacagcagccaccgcagcaattgcaatatcaccaaaatcagccccacgacggccataaccacgaacagcaccaaacagtacaaaaggatatgcaaacgcatgaatcgctagaaataatgggaaacacattattggaagagttcaaagacattaaaatggtgaacggcgagttgaagtatgtgaagccagaagattagcatatagatgaaatcaaacttagacgtatctctcgtccattttcattacattttcatctttcttcattaattatatactgaacatatacgcatctatacaattttgactttttaaagaagaaaaagaaaacaatagtatacattcttttttctacttttgttacagataaaaaatcgttcttattatattacatatatcggtgctaagatcaggattttttcatgttccttccccctgttatttcacatcatccttttgccggtagattaggctggtgtaaatagtagtgcttttctcatacatacaagacatacgtgaagataagtcccattttctctccctctgtcattaattttgaaagttcgttgagcactcatgaaaactgcgtccttttgtttttttgatctgaagtaaatatgtgtgagcaagataagcacacaaagaataaaaccatcgaagtatcctttcttctttgttgtgattgaaaaaacacattttcccgagagtgacatttgggacattctctatcagatctcggaagagtgggatcggaaccaatatcttgcaccactcccgcagtttcaccaatgttggtaatcaattcatgcctgtagaccaatggactgcccgcttcttctacatacgagcatgttctgcattcaaataacaaccggttattttctttatcctcacgagggtacaacatattgttgcagtcacgacaaaatctaaacgtagtcatagcagttttaaggggagtttaacttgctcttttggctagattttgtaactttcgttcggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcataacttgtgagagaaagtaggtttatacataattttacaactcattacgcacactcatggtttttggccagcgaaaacagtttcaaaagattgctggaagtctgcaataatgtcatcaataaattcgataccaacagagacacgaattaagtccttggtaacaccagatgccaacttttctttgtcatttaattgtttgtgggtagtgaagtatggagcaatgactaaggtcttggcatcaccaacattggccaagttagaggcaagctttaaattgtcaacaacttgagcaccagaaagtttgaatgggtcagtttccttgtcggcatttggtaagtcttttacaccgaaagataagacaccaccgaaaccgttagatagatacttcttagcattttcatgatgagaatgagatgctaaaccagggtatgaaacccaagatacgtatggggattgttctaaccatttggctaacttcaatgcattttcaccgtgtctttcagctctcaaagataatgtttcaacaccttgtagtagcaagaaagaggcaaatgggttcatcaatggacccaaatctcttaatagttcagttctaacatgaacgatgtatgccaagttaccgtaggcttcattgtagatagtaccgtgatatccttcggcaggttgagagaattgagggaacttttctgggtagtccttccatgggaacttaccagagtcaacaataataccaccgatagtagtaccatgaccaccaatccatttggtagcagaatgtgttacaatatcagcaccgtatttaattggctgacagaagtaaccaccggcaccaaatgtgttgtcaacgacaactggaataccgtgtttgtgagcaattgcaacaattttttcaaaatccggaacattgtactttggattaccaatggtttccaaataaacagccttggttctttcatcaaagaccttttcgaattcttctggattgtcaccttcaacaaatctagcctcgataccaaatcttttgaacgagattttgaactggttataagtaccaccgtataagtaagaagtggaaacgatgttgtcaccagtgtgtgccaaaccttggatggcaagggtttgagcggcttgaccggaggaaacagccaaagcagcagcaccaccttctaaagcagcaattctttcttccaaaacattactggttgggttttggaaacgggaatagacgtaacctggaacttctagaccaaacaattgcgaaccatgcttagagttttcgaaaacataagaagtggtggcgtaaattggtacagctctggatctgtgagcattgtcaccagggttctcttggccggcgtgtagttgaacagtatcgaaatgagatggcattgtatggatgggggtaatagaattgtatctatgtatctgacgaccctgtattacacgaaggaaatagtagatgaaaagacaagagagcaagaaaaaggaaaaacttcctttctaacagacgctttacttaaccttatatatatcttatttttttcatcgagcgtgttcaattggacaaggtgccaccttttcgacacttcggttattatgttacacagttttcatgaggatggctatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 921 - DNA, 16387 bp, artificial sequence
  construct
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcgctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaagcatctaaaacacaaccgttggaagcgttggaaaccaacttagcatacttggatagagtacctcttgtgtaacgaggtggaggtgcaacccaactttgtttacgttgagccatttccttatcagagactaataggtcaatcttgttattatcagcatcaatgataatctcatcgccgtctctgaccaacccgataggaccaccttcagcggcttcgggaacaatgtggccgattaagaacccgtgagaaccaccagagaatctaccatcagtcaacaatgcaacatctttacccaaaccgtaacccatcagagcagaggaaggctttagcatttcaggcatacctggtgcacctcttggaccttcatatctgataacaacaacggttttttcacccttcttgatttcacctctttccaaggcttcaataaaggcaccttcctcttcgaacacacgtgctctacccttgaagtaagtaccttccttaccggtaattttacccacagctccacctggtgccaatgaaccgtacagaatttgcaagtgaccgttggccttgattgggtgggagagtggcttaataatctcttgtccttcaggtaggcttggtgctttctttgcacgttctgccaaagtgtcaccggtaacagtcattgtgttaccgtgcaacatgttgttttcatatagatacttaatcacagattgggtaccaccaacgttaatcaaatcggccatgacgtatttaccagaaggtttgaagtcaccgatcaatggtgtagtatcactgattctttggaaatcatctggtgacaacttgacacccgcagagtgagcaacagccaccaaatgcaaaacagcattagtggacccaccggttgcaacgacataagtaatggcgttttcaaaagcctcttttgtgaggatatcacgaggtaaaatacccaattccattgtcttcttgatgtattcaccaatgttgtcacactcagctaacttctccttggaaacggctgggaaggaagaggagtttggaatggtcaaacctagcacttcagcggcagaagccattgtgttggcagtatacataccaccacaagaaccaggacctgggcatgcatgttccacaacatcttctctttcttcttcagtgaattgcttggaaatatattcaccgtaggattggaacgcagagacgatatcgatgtttttagagatcctgttaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaataaaaatgaaggtgttttacgataaagactgcgatctgagcatcatccagggaaagaaggttgctattataggatttggttcccaaggacacgcacaagccttgaacttgaaagattctggggtcgacgtgacagtaggtctgaacaaaggtaatgctgatgcagcaaaggctgaagcacatggctttaaagtcacagatgttgcagcggctgttgctggcgctgatttagtcatgattttaattccagatgaatttcaatcgcaattgtacaaaaatgaaatagaaccaaacattaagaagggcgctaccttggccttcagtcatggatttgccattcattacaatcaagtagtccccagggcagatttggacgttattatgattgcacctaaggctccggggcatactgttaggagcgaatttgttaagggtggtggtattccagatttgatcgctatataccaagacgttagcggaaacgctaagaatgtagctttaagctacgcagcaggagttggtggcgggagaacgggtataatagaaaccacttttaaagacgagactgagacagatttatttggagaacaagcggttctgtgcggaggaactgttgaattggttaaagcaggctttgagacgcttgtcgaagcagggtacgctcccgaaatggcatacttcgaatgtctacatgaattgaagttgatagtagacttaatgtatgaaggtggtatagctaatatgaactattccatttcaaataatgcagaatatggtgagtatgtcaccggacctgaagtcattaacgcagaatcaagacaagccatgagaaatgccttgaaacgtatccaggacggtgaatacgctaagatgttcataagtgaaggcgctacgggttacccgagtatgactgctaaaagaagaaacaatgcagcacatggtatcgaaattattggtgaacagttaaggtctatgatgccctggatcggtgctaataagatcgtagacaaggcgaaaaattaaggccctgcaggcctatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagtatataatttttcaggtaaaatttagtacgatagtaaaatacttctcgaactcgtcacatatacgtgtacataatgtctgaaccagctcaaaagaaacaaaaggttgctaacaactctctagagcggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattattggttttctggtctcaactttctgacttccttaccaaccttccagatttccatgtttctgatggtgtctaattccttttctagcttttctctgtagtcaggttgagagttgaattccaaagatctcttggtttcggtaccgttcttggtagattcgtacaagtcttggaaaacaggcttcaaagcattcttgaagattgggtaccagtccaaagcacctcttctggcggtggtggaacaagcatcgtacatgtaatccataccgtacttaccgatcaatgggtatagagattgggtagcttcttcgacggtttcgttgaaagcttcagatggggagtgaccgttttctctcaagacgtcgtattgagccaagaacataccgtggataccacccattaaacaacctctttcaccgtacaagtcagagttgacttctctttcgaaagtggtttggtaaacgtaaccggaaccaatggcaacggccaaagcttgggccttttcgtgagccttaccggtgacatcgttccagacggcgtaagaagagttaataccacgaccttccttgaacaaagatctgacagttctaccggaaccctttggagcaaccaagataacatctaagtcctttggtggttcaacgtgagtcaagtccttgaagactggggagaaaccgtgggagaagtacaaagtcttacccttggtcaacaatggcttgatagcaggccaggtttctgattgagcggcatcggacaacaagttcataacgtaactacctctcttgatagcatcttcaacagtgaacaagttcttgcctggaacccaaccgtcttcgatggcagccttccaagaagcaccatctttacggacaccaatgataacgttcaaaccgttgtctctcaagttcaaaccttgaccgtaaccttgggaaccgtaaccgatcaaagcaaaagtgtcgttcttgaagtagtccaacaacttttctcttggccagtcagctctttcgtagacggtttcaacagtaccaccgaagttgatttgcttcaacatcctcagctctagatttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcaattatttagtactgtcagtattgttattcatttcagatctatccgcggtggagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 922 - protein, 114 aa, Escherichia coli str. K-12 substr. MG1655
MSDDVALPLEFTDAAANKVKSLIADEDNPNLKLRVYITGGGCSGFQYGFTFDDQVNEGDMTIEKQGVGLVVDPMSLQYLVGGSVDYTEGLEGSRFIVTNPNAKSTCGCGSSFSI

SEQ ID NO: 923 - protein, 191 aa, Escherichia coli str. K-12 substr. MG1655
MIRISDAAQAHFAKLLANQEEGTQIRVFVINPGTPNAECGVSYCPPDAVEATDTALKFDLLTAYVDELSAPYLEDAEIDFVTDQLGSQLTLKAPNAKMRKVADDAPLMERVEYMLQSQINPQLAGHGGRVSLMEITEDGYAILQFGGGCNGCSMVDVTLKEGIEKQLLNEFPELKGVRDLTEHQRGEHSYY

SEQ ID NO: 924 - protein, 401 aa, Escherichia coli str. K-12 substr. MG1655
MNVFNPAQFRAQFPALQDAGVYLDSAATALKPEAVVEATQQFYSLSAGNVHRSQFAEAQRLTARYEAAREKVAQLLNAPDDKTIVWTRGTTESINMVAQCYARPRLQPGDEIIVSVAEHHANLVPWLMVAQQTGAKVVKLPLNAQRLPDVDLLPELITPRSRILALGQMSNVTGGCPDLARAITFAHSAGMVVMVDGAQGAVHFPADVQQLDIDFYAFSGHKLYGPTGIGVLYGKSELLEAMSPWLGGGKMVHEVSFDGFTTQSAPWKLEAGTPNVAGVIGLSAALEWLADYDINQAESWSRSLATLAEDALAKRPGFRSFRCQDSSLLAFDFAGVHHSDMVTLLAEYGIALRAGQHCAQPLLAELGVTGTLRASFAPYNTKSDVDALVNAVDRALELLVD

SEQ ID NO: 925 - protein, 138 aa, Escherichia coli str. K-12 substr. MG1655 [sequence omitted]

SEQ ID NO: 926 - protein, 147 aa, Escherichia coli str. K-12 substr. MG1655
MTNPQFAGHPFGTTVTAETLRNTFAPLTQWEDKYRQLIMLGKQLPALPDELKAQAKEIAGCENRVWLGYTVAENGKMHFFGDSEGRIVRGLLAVLLTAVEGKTAAELQAQSPLALFDELGLRAQLSASRSQGLNALSEAIIAATKQV

SEQ ID NO: 927 - protein, 89 aa, Helicobacter pylori B38
MIEFSDEDLQKPVRIVIEKIRPYLLKDGGNIEVLGVKSMKIYVALEGACKTCSSSKITLKNVIERQLKMDIHPNLEVVCLENAKEFDKL

SEQ ID NO: 928 - protein, 440 aa, Helicobacter pylori B38
MQAFLNRSFAPLLNPNESPLEQVKSSIILKKGVSYFDWGASGLASVLVEKRVKSLLPYYANAHSVASKHAILMGMLLKECQEKLKRSLNLSDNHCVLSAGYGASSAIKKFQEILGVCIPSKTKKNLEPYLKDMALKRVIVGPYEHHSNEISWREGLCEVVRIPLNEHGLLDLEILEQTLKKSPNSLVSMSAASNVTGLLTPLKEVSSLCKKYKAALALDLANFSAHANPKDCEYQTGFYAPHKLLGGIGGCGLLGISKDLIDTQIAPSFSAGGVIKYANRTRHEFIDELPLREEFGTPGLLQFYRSALAYQLRDECGLDFIHKKENNLLRVLMHGLKDLPAINIYGNLTASRVGVVAFNIGGISPYDLARVLSYEYAIETRAGCSCAGPYGHDLLNLNAQKSSDFNAKPGWLRVSLHFTHSINDIDYLLDSLKKAVKKLR

SEQ ID NO: 929 - protein, 259 aa, Azotobacter vinelandii DJ
MMFERMREDIRSVFQRDPAARNALEVLICYPGLHALWLHRLAHGLWCSDWKLLARLVSHVGRWLTGIEIHPGARIGRRLFIDHGMGVVIGETAEIGDDVTLYHGVTLGGTSWNKGKRHPTLEDGVIVGAGAKILGPFTVGAGAKIGSNAVVTRAVPAGATAVGIPGRIVARPDDEQEARRRAIAEKYGFDAYALGQNTPDPVAQAIGQLLDHLQAVDERLEGMCQALRALGSDYHAKELPALREEDFAGVKDEGGKSSA

SEQ ID NO: 930 - protein, 404 aa, Azotobacter vinelandii DJ
MKLPIYLDYSATTPVDPRVAQKMCECLTMEGNFGNPASRSHVFGWKAEEAVENARRQVAELVNADPREIVWTSGATESDNLAIKGVAHFYASKGKHIITSKIEHKAVLDTTRQLEREGFEVTYLEPGEDGLITPAMVAAALREDTILVSVMHVNNEIGTVNDIAAIGELTRSRGVLYHVDAAQSTGKVAIDLERMKVDLMSFSAHKTYGPKGIGALYVRRKPRVRLEAQMHGGGHERGMRSGTLATHQIVGMGEAFRIAREEMAAESRRIAGLSHRFHEQVSTLEEVYLNGSATARVPHNLNLSFNYVEGESLIMSLRDLAVSSGSACTSASLEPSYVLRALGRNDELAHSSIRFTFGRFTTEEEVDYAARKVCEAVGKLRELSPLWDMYKDGVDLSKIEWQAH

SEQ ID NO: 931 - protein, 128 aa, Azotobacter vinelandii DJ
MAYSDKVIDHYENPRNVGKLDAQDPDVGTGMVGAPACGDVMRLQIKVNEQGIIEDAKFKTYGCGSAIASSSLATEWMKGRTLEEAETIKNTQIAEELALPPVKIHCSVLAEDAIKAAVRDYKHKKGLV

SEQ ID NO: 932 - protein, 107 aa, Azotobacter vinelandii DJ
MAVTMTEAAARHIRRSLDGRGKGEGIRLGVRTSGCSGLAYVLEFVDEVASEDQVFESHGVKVIVDPKSLVYLDGTELDFVREGLNEGFKFNNPNVRGECGCGESFNI

SEQ ID NO: 933 - protein, 173 aa, Azotobacter vinelandii DJ
MGNASHFALFDLEPDFRLDQDRLAVRYRELVRRVHPDRFAGAPEREQRLALEEAARLNEAYQTLKSPSQRARYLLSLQGEELSQETTVQDPAFLMQQMELREELQELQDSADLAGVARFKRRLVQDQEQLNEGFAACWADPRRRDEAERLARRMQFLDKLFAEVRQLEERLDD

SEQ ID NO: 934 - protein, 621 aa, Azotobacter vinelandii DJ
MALLQIAEPGQSPQPHQRRLAVGIDLGTTNSLVATLRSGLAESLKDTEGETILPSAVRYLPDGRVEVGRAAKAAAAVDPLNTVLSVKRLMGRGIADVKLLGEQLPYRFAEGESHMPFIETVQGPKSPVEVSAEILRVLRRRAEEALGGELVGAVITVPAYFDEAQRQATKDAARLAGLDVLRLLNEPTAAAVAYGLDRGAEGVVAIYDLGGGTFDISILRLTRGVFEVLATGGDSALGGDDFDHAIANWIVEQAGLSADLDPGVQRHLLQLACAAKEALSDSGSVALAYGPWQGELSRERFEALIEPLVARSLKACRRALRDAGIEPQEIAAVVMVGGSTRVPRVRRAAAELFDRQPLTDIDPDQVVAIGAALQADTLAGNGRDGEELLLLDVNPLSLGLETMGRLMEKVIPRNTTLPVARAQEFTTYKDGQTAMLIHVLQGERELVKDCRSLARFELRGIPPMVAGAAKIRVTFQVDADGLLNVSARELGSGIEASVQVKPSYGLTDGEIARMLKDSFEYAGGDKAARALREQQVEAQRLLEAVQAALEADGEALLSPAERAAIEAQMQALRGVLDGPDAAVIETHVRHLTQVTDAFAARRLDASVKAALSGRRLNEIEE

SEQ ID NO: 935 - protein, 113 aa, Azotobacter vinelandii DJ
MMPQIVFLPHEVHCPEGRVVEAETGESILEAALRNDIEIEHACEMSCACTTCHVIVRDGFDSLEPSDELEDDMLDKAWGLEPESRLSCQARVGTEDLVVEIPRYTINQVSEQH

SEQ ID NO: 936 - protein, 449 aa, Azotobacter vinelandii DJ
MVENAARFSTLRIADESVSYKNGVYNESHDDKRRRPEGLPIIHDDAPTMSLPSPWRADFPAFAAFARDGQTYLDSAATAQKPQAMLDALLGHYAGGAANVHRAQHCPGERATRAFEAARAKVAAWLNAGSAERIVFTRGATESLNLLAYGLEHLFAPGDTIAVGALEHHANLLPWQRLAQRRGLDLVVLPLDGAGDIDLEQAERLIGPRTRLLAVSQLSNVLGRWQPLDALLALASSRGALTVVDGAQGAVHGRHDLRSLACDFYVFSAHKLYGPDGLGVLHGRPQALERLQHWQFGGEMVQQADYHEARFRPAPLGFEAGTPAIGAAIAFGATLDYLQSLDGTAVAAHEAALHRRLLAGLRAVAGLRLLAEPHNALASFVIEGVHNADLAHLLAEQGIAVRAGQHCAMPLLRRLGLPGALRVSLGLYSDGNDLERFFAALERALELLR

SEQ ID NO: 937 - protein, 134 aa, Azotobacter vinelandii DJ
MSLPAAAGEALEAFARCPGWEQRARLLLQWGERLEALSDAERCSANQVQGCESQVWLLGERRDGHWHFRAGSDARLLRGLLAVLLARVDGLDAQALRAVDLADWFARLGLSRQLSPSRSNGLNAVLQRMRELAG

SEQ ID NO: 938 - protein, 327 aa, Azotobacter vinelandii DJ
MSNKPKAVFDGVSHTPEVPAPRPVNWQLEQIVDELRAARADWRKNCGRTRELGSRELPSRQTVAEILAALSGALFPMRLGPSDLREESEDFYVGHTLDSALNALLGQVRLELHYVARQCGQREPDLETRAVQIVREFGAALPEMRRLLDSDVIAAYQGDPAARSLDEVLICYPGVQAVIHHRLAHLLYRSGVPLLARIVAEIAHSATGIDIHPGAQIGHSFFIDHGSGVVIGETAVIGNRVRIYQAVTLGAKRFTVDESGQLLKGQARHPIVEDDVVIYAGATILGRITIGKGSIIGGNVWLTRSVPPGSNVTQATLQHQPGNAGQP

SEQ ID NO: 939 - protein, 604 aa, Azotobacter vinelandii DJ
MADLARLANAFFASLPGSAPSDGVPSGGAPFGKGLSDSVLPGGVSALAGVSPVEPFPSGAAASLGAAERHAGETLPAGIADGLELGSPEAYAAALPTLFPAAGGLAPLAGGAPSTPYYFLGEGSAYSGEPERFADLPVEPDSRAVPGGDALGEVLRSILAEPSAPAAPAGPGAGQFYFLERSGPGLEQAPDPVVQPQVRSGFDVQAVRRDFPILAERVNGKPLVWFDNAATTQKPKAVIDRLAYFYEHENSNIHRAAHELAARATDAYEGARSKAARFLGAKSTDEIVFVRGATEGINLLANTFGRRFIGEGDEIIVSHLEHHANIVPWQLLANAVGARLKVIPVDDSGQIILEEYARLLGPRTRLVSITQVSNALGTVTPVAEVIALAHAAGARVLVDGAQSVSHLKVDVRALDADFFVFSGHKVFGPTGIGVVYGKQELLDELPPWQGGGNMIADVTFEKTQYQGAPARFEAGTGNIADAVGLGAALDYVERIGLEAIARYEHELLEYATRGLATIPGLRLIGTAANKASVLSFVLQGYRTEEIGAALNREGVAVRSGHHCAQPILRRFGVETTVRPSLAFYNTFDEIDLLVSTVHRLATRR

SEQ ID NO: 940 - DNA, 345 bp, Escherichia coli str. K-12 substr. MG1655
atgagtgatgacgtagcactgccgctggagtttaccgacgcagcagccaacaaagttaaaagcctgatcgctgacgaagataacccgaatctgaaattacgcgtgtatatcaccggtggcggttgcagcggcttccagtatggtttcacctttgatgatcaggtgaacgaaggcgatatgaccatcgaaaaacagggcgttggcctggtggttgatccgatgagcctgcaatatctggtcggcggttccgttgattataccgaaggtctggaaggttctcgtttcatcgtgaccaacccgaacgcgaaaagcacctgcggttgcggttcttcctttagtatctaa

SEQ ID NO: 941 - DNA, 576 bp, Escherichia coli str. K-12 substr. MG1655
atgatccgtatttccgatgctgcacaagcgcactttgccaaactgctggcaaatcaggaagaagggacacaaatccgcgtatttgtgattaaccctggcacgcctaacgctgaatgtggcgtttcttattgtccgccggacgctgtggaagccaccgacacagccctgaaatttgacctgctgaccgcgtatgttgatgagttaagcgcaccatacctggaagatgcagagatcgattttgttaccgaccagttgggttcccagttaacgctgaaagccccgaacgccaaaatgcgtaaagtggcagacgatgcaccgctgatggagcgcgtggagtatatgctgcagtcgcagatcaacccacagcttgctggtcacggtggtcgcgtttcgctgatggaaatcaccgaagacggttacgccattctgcaatttggcggcggctgtaacggttgttccatggtcgatgtgacgctgaaagaagggatcgagaagcagctgctgaacgaattcccggagctgaaaggtgtgcgcgatctcaccgaacaccagcgcggcgaacactcctactactaa

SEQ ID NO: 942 - DNA, 1206 bp, Escherichia coli str. K-12 substr. MG1655
atgaacgtttttaatcccgcgcagtttcgcgcccagtttcccgcactacaggatgcgggcgtctatctcgacagcgccgcgaccgcgcttaaacctgaagccgtggttgaagccacccaacagttttacagtctgagcgccggaaacgtccatcgcagccagtttgccgaagcccaacgcctgaccgcgcgttatgaagctgcacgagagaaagtggcgcaattactgaatgcaccggatgataaaactatcgtctggacgcgcggcaccactgaatccatcaacatggtggcacaatgctatgcgcgtccgcgtctgcaaccgggcgatgagattattgtcagcgtggcagaacaccacgccaacctcgtcccctggctgatggtcgcccaacaaactggagccaaagtggtgaaattgccgcttaatgcgcagcgactgccggatgtcgatttgttgccagaactgattactccccgtagtcggattctggcgttgggtcagatgtcgaacgttactggcggttgcccggatctggcgcgagcgattacctttgctcattcagccgggatggtggtgatggttgatggtgctcagggggcagtgcatttccccgcggatgttcagcaactggatattgatttctatgctttttcaggtcacaaactgtatggcccgacaggtatcggcgtgctgtatggtaaatcagaactgctggaggcgatgtcgccctggctgggcggcggcaaaatggttcacgaagtgagttttgacggcttcacgactcaatctgcgccgtggaaactggaagctggaacgccaaatgtcgctggtgtcataggattaagcgcggcgctggaatggctggcagattacgatatcaaccaggccgaaagctggagccgtagcttagcaacgctggcggaagatgcgctggcgaaacgtcccggctttcgttcattccgctgccaggattccagcctgctggcctttgattttgctggcgttcatcatagcgatatggtgacgctgctggcggagtacggtattgccctgcgggccgggcagcattgcgctcagccgctactggcagaattaggcgtaaccggcacactgcgcgcctcttttgcgccatataatacaaagagtgatgtggatgcgctggtgaatgccgttgaccgcgcgctggaattattggtggattaa

SEQ ID NO: 943 - DNA, 417 bp, Escherichia coli str. K-12 substr. MG1655
atggctttattgccggataaagaaaagttgctgcgtaattttttacgctgcgccaactgggaagagaaatatctctacattattgagctgggccagcgtctgccagaattacgcgacgaagacagaagtccacaaaatagcattcagggctgtcagagtcaggtgtggattgtcatgcgccagaatgcccagggaattattgaattacagggcgacagcgatgcggcgattgtgaaagggcttattgcggtcgtctttattctctacgatcagatgacgccgcaggatattgtcaatttcgatgtgcgtccgtggtttgaaaaaatggcgctcacccaacatctcaccccatctcgttcacaaggtctggaagcgatgattcgcgcaattcgcgccaaagccgctgcacttagctaa

SEQ ID NO: 944 - DNA, 444 bp, Escherichia coli str. K-12 substr. MG1655
atgacaaacccgcaattcgccggacatccgttcggcacaaccgtaaccgcagaaacgttacgcaataccttcgcaccgttgacgcaatgggaagataaatatcgccagttgatcatgctggggaaacagcttccggcattgccagacgagttaaaagcgcaggctaaagagattgccggatgcgaaaaccgcgtctggctgggatatacagtggctgaaaacggcaaaatgcatttctttggcgacagcgaagggcgcattgtgcgcggcctgctggcggtgttgttgactgccgttgaggggaaaaccgccgccgagttgcaggcacagtcaccactggcattgtttgatgagctgggattacgtgcgcagcttagcgcctcacgcagccaggggttaaatgcgttaagcgaggcgattatcgctgcgacgaagcaggtttaa

SEQ ID NO: 945 - DNA, 270 bp, Helicobacter pylori B38
atgatagaatttagcgatgaagatttacaaaaaccggtgcgtattgtgatagaaaaaatccgcccttacttgctcaaagatggcggtaatattgaagtgctaggggtgaaaagcatgaaaatttatgtggctttagagggagcgtgtaagacttgctctagcagtaagatcactttaaaaaatgtcattgaacggcagcttaaaatggacattcaccccaatttagaagtggtgtgcttagaaaacgctaaggagtttgataagctttaa

SEQ ID NO: 946 - DNA, 1323 bp, Helicobacter pylori B38
gtgcaagcgtttttaaacaggagttttgctcccttactcaatcctaatgaaagtcctttagagcaagttaaatccagtattattttaaaaaaaggggtgtcttattttgactggggggcttcaggtttagcgagcgttttagtggaaaagcgcgtgaaatctttactgccttattatgcgaacgctcattctgtcgcttctaaacatgcgattttaatgggcatgcttttaaaagagtgccaagaaaagttaaagcgttctttaaatttgagcgataatcattgcgtcttgagcgcggggtatggggcgagttcagcgattaagaaatttcaagaaattttaggggtgtgtatcccttcaaaaacgaagaaaaatttagagccgtatttgaaagatatggctttaaagcgtgtgattgtagggccttatgagcatcattctaatgagattagctggcgtgaaggcttgtgtgaagtggtgcgtatccctttaaatgaacatggtttattggatttagaaattttagagcaaactttaaaaaaatcccctaacagcctggtttctatgagcgcggcttctaatgtaaccggactgcttacgcccttaaaagaagtttcatcattgtgcaagaaatataaggccgctttggctttggatttagcgaattttagcgcgcatgctaaccctaaagattgcgaataccaaaccggtttttatgcgcctcataagcttttagggggcattggagggtgcggtcttttaggcatttctaaagatttgattgacacgcagatcgccccgagttttagcgcagggggcgtgattaaatacgctaatcgcacacggcatgaatttattgatgaattgcctttaagagaagagtttggcacgccagggttgttgcaattttacaggagcgctctagcgtatcaattaagagatgaatgcggtttggattttatccacaagaaagaaaacaaccttttaagagtgctaatgcatggcttaaaagacttgcccgctattaatatttatgggaatttaacagcgagtcgtgtgggggtagtggcttttaatattggggggatttcgccctatgatttagcgagggttttaagctatgaatacgctattgagacccgggcaggttgctcttgcgcggggccttatgggcatgatttattgaatcttaacgctcaaaagtcaagcgattttaacgctaaacccggatggcttagagtgagtttgcatttcacgcattccataaacgatattgattatttgctagacagcttgaaaaaagcggttaaaaaattgcgttaa

SEQ ID NO: 947 - DNA, 780 bp, Azotobacter vinelandii DJ
gtgatgttcgaacgcatgcgagaagatatccggagcgttttccagcgcgatcctgccgcgcgcaatgccctcgaggtgctgatctgctatccggggctgcacgcgctgtggctgcatcgcctggcgcacgggctgtggtgctccgactggaagctgctggcgaggctggtttcgcatgtggggcgctggctgaccggcatcgagatccatccgggcgcgcggatcggccggcgcctgttcatcgaccacggcatgggcgtggtgatcggcgagaccgccgagatcggcgacgacgtcaccctctatcacggggtgaccctgggtggtaccagttggaacaagggcaagcgccacccgaccctggaggacggggtgatcgtcggcgccggggcgaagattctcggtcccttcaccgtcggcgccggcgccaagatcggctccaacgccgtggtgacgcgggcggtgccggccggcgccacggcggtggggattcccggacgcatcgtcgccaggccggacgacgaacaggaggccaggcgccgggcgatcgccgagaaatatggcttcgacgcctacgcgctcggccagaacacgccggacccggtggcgcaggccatcggccagttgctcgaccatctgcaggccgtcgacgagcggctcgagggcatgtgtcaggcgctccgggcgctgggcagcgattatcatgccaaggagctgccggcgcttcgcgaggaggatttcgccggcgtcaaggatgagggcggcaagtcgtcggcctga

SEQ ID NO: 948 - DNA, 1215 bp, Azotobacter vinelandii DJ
atgaagttgccgatttatctggattattccgccaccactccggtcgacccgcgggtggcgcagaagatgtgcgagtgcctgaccatggagggcaatttcggcaatccggcctcgcgttcccacgtcttcggctggaaggccgaggaggccgtggagaacgcccgccgtcaggtggcggaactggtcaacgccgatccgcgggagatcgtctggacttccggcgccaccgagtccgataacctggcgatcaagggcgtcgcgcacttctacgcgagcaagggcaagcacatcatcacctcgaagatcgaacacaaggcggtgctggataccacccgccagctcgagcgcgaaggtttcgaggtgacctacctcgagcccggcgaggatggcctgatcactccggcgatggtcgcggcggcgctgcgcgaggacaccatcctggtctcggtgatgcacgtcaacaacgagatcggcaccgtcaacgacatcgcagccatcggcgaactgacccgttcgcgcggcgtgctctatcacgtggatgccgcccagtcgaccggcaaggtggccatcgacctagagcgcatgaaggtcgacctgatgtccttctccgcccacaagacttacggccccaaggggatcggcgcgctctacgtgcggcgcaagccgcgcgtacgcctggaggcgcagatgcacggcggcggccacgagcgcggcatgcgttccggtaccctggcgacccaccagatcgtcggcatgggcgaggcctttcgcatcgccagggaagagatggccgcggaaagccggcgtatcgccgggctcagccatcgcttccacgagcaggtcagcaccctcgaagaggtctacctgaacggcagcgccacggcacgggtgccgcacaacctcaatctcagcttcaactacgtggaaggcgagtcgctgatcatgtcgctcagggatctggcggtttcctctgggtcggcctgcacctcggcgtccctggagccgtcctacgtgctgcgcgctctgggtcgcaacgacgaactggcgcacagctcgatccgcttcactttcggtcgtttcaccaccgaggaagaggtcgattacgctgcgcggaaggtatgcgaggcggtcggcaagctgcgcgagctgtcgccgctctgggacatgtacaaggatggggtcgatctgtccaagatcgagtggcaggcccactga

SEQ ID NO: 949 - DNA, 387 bp, Azotobacter vinelandii DJ
atggcttacagtgacaaggtcatcgaccactacgaaaacccgcgcaacgtcggcaagctcgacgcgcaggaccccgacgtcggcaccggcatggtgggcgcccccgcctgcggcgacgtgatgcgcctgcagatcaaggtcaacgagcagggcatcatcgaggacgccaagttcaagacctacggctgcggttcggccatcgcctccagttccctggccaccgagtggatgaaaggcaggaccctggaagaagccgaaaccatcaagaacacccagatcgccgaggaactggctttgccgccggtcaagatccactgctcggtcctggcggaggatgccatcaaggccgccgtgcgcgattacaagcacaagaaaggcctggtttga

SEQ ID NO: 950 - DNA, 324 bp, Azotobacter vinelandii DJ
atggccgtcaccatgaccgaagccgccgcccgccacatccggcgttccctcgatggacgcggcaagggcgagggcatccgcctgggcgtccgcaccagcggttgctcggggctggcctacgtgctcgagttcgtcgacgaggtggccagcgaggaccaggtgttcgagagtcacggggtcaaggtgatcgtcgatcccaagagcctggtctacctggatggcaccgagctggacttcgtccgcgaaggactcaacgaaggcttcaagttcaacaacccgaacgtgcgtggcgagtgtggctgcggcgaaagcttcaacatctga

SEQ ID NO: 951 - DNA, 522 bp, Azotobacter vinelandii DJ
atgggtaatgccagccatttcgccctgttcgacctcgagccggattttcgcctcgatcaggaccggctcgcggtgcgttaccgcgaactggtgcgccgggtgcatcccgaccgtttcgccggtgcccccgaacgcgaacagcgcctggcgctggaggaggccgcccggctcaacgaggcctaccagacgctgaaaagtccgtcgcagcgcgcccgttacctgctgtccctgcagggagaagagctgtcccaggaaaccacggtgcaggaccctgccttcctcatgcagcagatggagttgcgtgaagagctccaggaactgcaggacagtgccgacctggccggggtggcgcgcttcaagcgccggctcgtgcaggaccaggagcaactgaacgaaggtttcgccgcctgctgggccgatccgcggcggcgcgacgaggccgaacgcctggcacggcgcatgcaatttctcgacaagctctttgccgaggtccgccagctcgaagagcgtctcgacgactaa

SEQ ID NO: 952 - DNA, 1866 bp, Azotobacter vinelandii DJ
atggccttattgcagatcgccgaacccggacaaagcccgcaaccccaccagcgtcgcctggcggtcgggatcgacttgggaaccaccaattcgctggtcgccaccttgcgcagcggcctggccgaatccctgaaggacaccgagggggaaacgatcctgccgtcggcggtacgctacctgcccgacggccgggtcgaggtcggccgcgcagccaaggctgccgccgccgtggacccgttgaacaccgtgctctcggtgaagcgcctgatgggacgcggcatcgccgatgtcaagctgctcggcgagcagttgccgtaccgtttcgccgagggcgagtcgcacatgcccttcatcgagacggtgcagggaccgaaaagcccggtcgaagtgtcggcggagatcctcagggtgctgcgccggcgcgccgaggaagccctgggcggcgaactggtcggcgcggtgatcaccgtgccggcctatttcgacgaggcgcagcgccaggccaccaaggatgccgcgcggctggccggcctcgatgtgctgcgcctgctcaacgagccgaccgcggcggcggtcgcctacggcctcgaccggggcgccgagggcgtggtagcgatctacgacctgggcggcggtaccttcgacatctccatcctgcgcctgacccgcggggtcttcgaggtgctcgccaccggcggcgacagcgccctgggcggcgacgacttcgaccatgccatcgccaactggattgtcgagcaggcgggactgtccgccgatctcgacccgggcgtccagcgccatctgctgcaactggcctgtgcggccaaggaggcgctgagcgacagcggctcggtggcgctcgcctatggtccctggcagggcgagctgtcccgcgagcgtttcgaggcactgatcgagcccctggtggcacgcagcctcaaggcctgccggcgggcgctgcgcgatgccgggatcgagccgcaggagatcgccgcggtggtcatggtcggcggctccacccgggtgccgcgggtgcgccgggcggccgccgaactgttcgaccgccagccgctgaccgacatcgaccccgatcaggtggtcgccatcggcgcggcgctccaggccgacaccctggccggcaacgggcgcgacggcgaggagttgctgctgctggatgtcaatccgctgtccttgggcctcgagaccatgggcaggctgatggaaaaggtcatcccgcgcaacaccaccctgcccgtggcgcgagcccaggaattcaccacttacaaggatggccagacggccatgctgatccacgtcctgcagggggagcgcgaactggtcaaggactgtcgctccctggcgcgcttcgagctgcgcgggattccgcccatggtggcgggggcggcgaagatccgggtcaccttccaggtcgatgccgacggcctgctcaatgtctccgcccgcgagctgggctccggcatcgaggcgagcgtgcaggtcaaaccgtcctacggcctgaccgacggcgaaatcgcacggatgctcaaggactccttcgagtatgccggcggcgacaaggctgcccgcgcgctgcgtgagcagcaggtcgaggcgcagcgtttgctggaagcggtgcaggcggccctggaggccgatggcgaggcgctgctgagtcccgccgagcgggccgccatcgaggcgcagatgcaggcgttgcgcggcgtgctggacgggccggacgccgccgtcatcgagacgcacgtccgccatctgacgcaggtcaccgatgccttcgccgcccggcgcctggacgcttcggtgaaggccgcgctgtccgggcgccgactgaacgaaatcgaggagtga

SEQ ID NO: 953 - DNA, 342 bp, Azotobacter vinelandii DJ
atgatgccgcagatcgtttttctgccccatgaggtgcattgccccgagggcagggtggtcgaggccgagactggcgagagcattctcgaggccgccctgcgcaacgatatcgagatcgagcacgcctgcgagatgtcctgtgcctgcaccacctgccatgtgatagtgcgcgacggcttcgattccctcgagccgtccgacgaactggaagacgacatgctcgacaaggcctgggggctggagccggagtcgcggctatcctgtcaggcgagggtcggcactgaggatctggtggtggagattccgcgctacaccatcaatcaggtttcggaacagcactga

SEQ ID NO: 954 - DNA, 1350 bp, Azotobacter vinelandii DJ
ttggtggaaaacgctgcgcggttttccaccctacggatcgcggacgaatccgtttcttacaaaaacggtgtttacaacgaatcgcatgacgacaaacgtcgccgccccgaaggcctccccatcattcacgacgacgcaccgaccatgtcccttccctccccctggcgggccgacttcccggccttcgccgccttcgcccgggacggccagacctacctggacagtgccgccaccgcgcagaagccacaggcgatgctggacgccctgctcggccactacgccggcggcgcggccaacgtgcaccgcgcccagcactgccccggcgagcgcgccacgcgggccttcgaggcggcgcgggcgaaggtcgccgcctggctgaacgccggaagcgccgagcggatcgtcttcacccgcggcgccaccgagtccctcaacctgctcgcctacggactcgaacacctgttcgcgccgggcgacacgatcgccgtcggcgccctggagcaccacgccaacctgctgccctggcaacgcctggcgcagcgccgcggtctcgacctggtggtgctgccgctggatggcgccggcgacatcgacctggagcaggccgagcggctgatcggcccgcgcacccggctgctcgcggtcagtcagttgtccaacgtgctcggccgctggcagccgctcgacgcactgctcgccctggccagttcccggggcgcgctgacggtggtcgacggcgcccagggcgcggtccacggtcgccacgacctgcggtcgctggcctgcgacttctacgtgttctccgcgcacaagctctacggcccggacggcctcggcgtgctccacggccgtccgcaggccctggaacgcctgcagcactggcagttcggcggcgagatggtgcagcaggccgactaccacgaggcgcgctttcgcccggcgccgctcggcttcgaggccggcaccccggcgatcggcgcggccatcgccttcggcgccaccctggactacctgcagagcctggacggcacggcggtcgccgcccacgaggcggctctgcaccggcgcctgctcgccggactgcgcgctgtcgccggtctgcgcctgctcgccgagccgcacaacgcgctggccagtttcgtgatcgaaggggtgcacaacgccgatctggcccatctgctcgccgaacagggcatcgccgtgcgcgccggccagcactgcgccatgccgctgctgcgccgcctcggcctgcccggcgcgctgcgcgtgtcgctcggcctgtacagcgacgggaacgatctggagcgcttcttcgccgccctcgaacgcgccctggaactgctgcgatga

SEQ ID NO: 955 - DNA, 405 bp, Azotobacter vinelandii DJ
atgagcctgcccgccgccgccggcgaggccctggaagccttcgcccgatgccccggctgggaacagcgggcgcgcctgctgttgcagtggggcgagcgtctcgaagcgctgagcgacgcggagcgctgctcggccaaccaggtgcaggggtgcgagagccaggtctggctgctcggcgaacgacgggacggccactggcatttccgcgccggcagcgatgcgcggctgctgcgcggtttgctggcagtgctgctggcgcgggtcgatggcctcgatgcacaggccttgcgggccgtggatctggccgactggttcgcccgcctcggcctgtcccgccagctctcgccgtcgcgcagcaacggcctgaatgccgtgctgcaacgaatgcgcgaactggccggttag

SEQ ID NO: 956 - DNA, 984 bp, Azotobacter vinelandii DJ
atgtccaacaaacccaaggccgtcttcgacggcgtctcgcatacgccggaggtacccgcgccccggccggtgaactggcaactggagcagatcgtcgatgaactgcgtgccgctcgcgccgattggcgcaagaactgcggccggacgcgcgagctgggcagccgcgaattgccctcgcggcagaccgtggcggagattctcgccgcgctgagcggcgcgctctttccgatgcgcctcgggcccagcgatctgcgcgaagagagcgaggatttctatgtcgggcacaccctcgacagcgcactgaacgcgctgctcggccaggtacgcctggaactgcactatgtcgcccgccagtgcgggcagcgcgagccggatctggagacgcgcgcggtgcagatcgtccgcgaattcggcgccgccttgccggaaatgcgccggctgctggacagcgacgtgatcgccgcctaccagggcgatccggcggcgcgcagcctggacgaggtactgatctgctatccgggcgtccaggcggtgatccaccatcgcctggcccatcttctgtaccgctccggggtgccgctgctggcgcggatcgtcgcggagatcgctcattccgccaccggcatcgacatccatccgggagcgcagatcggtcacagcttcttcatcgaccacgggagcggcgtggtgatcggcgaaaccgcggtgatcggcaaccgcgtacgcatctatcaggcggtgaccctgggcgccaagcgcttcaccgtcgacgagtccggccagttgctcaagggccaggcccgtcatcctatcgtcgaagacgacgtggtaatttatgccggcgccaccattctgggccgcatcaccatcggcaagggttccatcatcggtggcaatgtctggctgacccgtagcgtgcctccgggcagcaacgtcacccaggcgaccttgcaacatcagccaggcaacgcggggcagccgtga

SEQ ID NO: 957 - DNA, 1815 bp, Azotobacter vinelandii DJ
gtggcggatctggcgcggctggccaacgccttcttcgccagcctgccgggtagcgctccgtcggacggcgttccgtcgggcggcgcgcccttcggcaagggtctgtcggacagcgttctgccgggcggcgtttcggcgctggccggcgtgtcgcccgtcgagccgtttccgagtggggccgccgcctcgctcggggcggccgaacggcacgccggggagacgcttccggcgggcatcgccgacggcctggagctcggctcgcccgaggcctacgccgccgcgttgccgacgctgttcccggctgccggcggcctcgcgccgttggccgggggcgcgccgtccacgccgtactacttcctcggcgagggcagcgcctacagcggcgagccggagcgcttcgcggaccttcccgtcgagccggacagccgcgcggtgccgggcggggacgcgctgggcgaggtcctccgctcgatcctcgccgagccgtccgcgccggcggcgccggcgggtccgggggccggacagttctatttcctcgaacggagcggtccgggcctggagcaggcgcccgatcccgtcgtccagccgcaggtccgcagcggtttcgacgtgcaggcggtgcgccgggacttcccgattctcgccgaacgggtcaacggcaagccgctggtgtggttcgacaacgccgccaccacgcagaagcccaaggcggtgatcgatcgcctggcgtacttctacgagcacgagaactccaacatccaccgcgccgcccacgagctggcggcgcgggcgacggacgcctacgagggcgcgcgcagcaaggcggcgcgctttctcggcgcgaagtcgacggacgagatcgtcttcgtgcgcggggcgaccgagggcatcaacctgctggccaacaccttcggccgccggttcatcggcgagggggacgagatcatcgtctcccacctggagcaccacgccaacatcgtgccctggcagttgttggccaacgcggtgggcgccaggctcaaggtgatcccggtggacgactccgggcagatcatcctggaggagtacgccaggctgctcggtccgcgcacccggctggtgagcatcacccaggtgtccaacgccctcggcacggtcaccccggtggcggaggtgatcgccctggcgcatgccgccggtgcgcgggtactggtggacggcgcgcagtcggtgtcgcacctgaaggtcgacgtgcgggcgctggacgcggacttcttcgtgttctccgggcacaaggtcttcgggccgaccggcatcggtgtggtctacggcaagcaggaactgctcgacgagctgccgccctggcagggcggcggcaacatgatcgccgatgtgaccttcgagaagacccagtaccagggtgcgccggcgcgcttcgaagccggtaccggcaacatcgccgatgcggtggggctcggtgcggcgctggactatgtcgagcgcatcggcctggaagccatcgcccgctacgagcacgaactgctggagtacgccacccggggcctcgcgacgattcccggcctgcgcctgatcggtaccgcggcgaacaaggccagcgtgctgtccttcgtgctgcagggctaccgcaccgaggagatcggcgccgccctcaatcgcgagggtgtcgccgtgcgttccggccaccactgcgcgcagccgatcctgcgccgtttcggggtggaaaccacggtgcggccgtcgttggcgttctacaacaccttcgacgagatcgacctgctggtgagcaccgtgcaccgtctggcgacccggcgctga

SEQ ID NO: 958 - protein, 570 aa, Artificial Sequence
  ILVD(Ll)
MEFKYNGKVESVELNKYSKTLTQDPTQPATQAMYYGIGFKDEDFKKAQVGIVSMDWDGNPCNMHLGTLGSKIKSSVNQTDGLIGLQFHTIGVSDGIANGKLGMRYSLVSREVIADSIETNAGAEYYDAIVAIPGCDKNMPGSIIGMARLNRPSIMVYGGTIEHGEYKGEKLNIVSAFEALGQKITGNISDEDYHGVICNAIPGQGACGGMYTANTLAAAIETLGMSLPYSSSNPAVSQEKQEECDDIGLAIKNLLEKDIKPSDIMTKEAFENAITIVMVLGGSTNAVLHIIAMANAIGVEITQDDFQRISDIIPVLGDFKPSGKYMMEDLHKIGGLPAVLKYLLKEGKLHGDCLTVTGKTLAENVETALDLDFDSQDIMRPLKNPIKATGHLQILYGNLAQGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVSNEEIAKRRANYQKPTPKATRGVLAKFAKLTRPASEGCVTDL

SEQ ID NO: 959 - DNA, 1710 bp, Lactococcus lactis
  IlvD
atggaattcaaatataacggaaaagttgaatcagtggaactcaataaatattctaagacattgactcaagatccaacacaaccagcgactcaagcgatgtactacggcattggttttaaagatgaggatttcaaaaaagctcaggtcggaatcgtcagcatggattgggacggaaatccatgtaatatgcacttgggaacacttgggagtaaaatcaaaagttctgtcaaccaaactgacggattgattggacttcaatttcatactattggagtttctgatggaattgctaacggaaagcttggcatgagatattctttggtcagtcgtgaagttattgctgacagcatcgaaaccaacgctggcgcagaatattatgatgccatcgttgccattcccggttgtgataaaaatatgcccgggtcaattatcggaatggctcgcttaaatcgtccgtcaattatggtctatggtggaacgattgaacatggcgaatataaaggtgaaaaattaaatattgtttcggcctttgaagctctggggcaaaaaatcactggaaatatttctgatgaagattatcatggcgttatttgcaatgccattccaggacaaggtgcttgcggaggaatgtacactgccaataccctggctgctgctattgaaactttgggaatgagtttaccttattcctcttccaatccagcagtcagtcaagaaaaacaagaagagtgtgatgacattggtttagccatcaaaaatttattagaaaaagatattaaaccaagtgatatcatgaccaaagaagcttttgaaaatgccataacaattgtcatggtccttggaggctcaaccaatgctgtgcttcatatcattgcaatggcaaatgccattggtgtagaaattacgcaagatgatttccaacgtatttcagatattatccctgttcttggcgatttcaaaccgagcggaaaatatatgatggaagatctgcacaaaattggtggccttcctgctgttttgaaatacctacttaaagaaggaaaacttcacggtgattgtttgaccgtcacaggtaaaactttggctgaaaatgttgaaacagcattagatttggactttgacagtcaagatattatgcgaccactaaaaaatccaattaaagctactggacatttacaaattttgtacggtaatcttgcccaagggggttctgttgcaaaaatttctggtaaagaaggcgaatttttcaaaggaacagctcgtgtttttgacggagaacaacactttatcgatggcattgagtctggccgattgcatgccggtgatgttgcggtcattagaaatattggcccagtcggaggtccgggaatgccagagatgttaaaaccaacctcagcattaattggagcaggacttggaaaatcttgtgccctaattactgacggaagattttctggtggcacacacggctttgttgtgggtcatatcgtccctgaagcagttgaaggtgggttgattggtttagttgaagatgatgatattatcgaaattgatgcggtgaataatagtattagtttaaaagtttctaatgaagaaattgctaaacgacgtgccaattatcaaaaaccaacccctaaagcaacgcgtggtgttcttgcaaaatttgccaaacttacgcgccccgctagtgaaggttgcgttacagattta

SEQ ID NO: 960 - DNA, 10247 bp, Artificial Sequence
  pHR81 FBA-IlvD(Ll)-ADHt
agctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctctcgaggtcgacggtatcgataagcttgatatcgaattcctgcagcccgggggatctgaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatgtataaccataaccaagtaatacatattcaaatctagagctgcatatggaattcaaatataacggaaaagttgaatcagtggaactcaataaatattctaagacattgactcaagatccaacacaaccagcgactcaagcgatgtactacggcattggttttaaagatgaggatttcaaaaaagctcaggtcggaatcgtcagcatggattgggacggaaatccatgtaatatgcacttgggaacacttgggagtaaaatcaaaagttctgtcaaccaaactgacggattgattggacttcaatttcatactattggagtttctgatggaattgctaacggaaagcttggcatgagatattctttggtcagtcgtgaagttattgctgacagcatcgaaaccaacgctggcgcagaatattatgatgccatcgttgccattcccggttgtgataaaaatatgcccgggtcaattatcggaatggctcgcttaaatcgtccgtcaattatggtctatggtggaacgattgaacatggcgaatataaaggtgaaaaattaaatattgtttcggcctttgaagctctggggcaaaaaatcactggaaatatttctgatgaagattatcatggcgttatttgcaatgccattccaggacaaggtgcttgcggaggaatgtacactgccaataccctggctgctgctattgaaactttgggaatgagtttaccttattcctcttccaatccagcagtcagtcaagaaaaacaagaagagtgtgatgacattggtttagccatcaaaaatttattagaaaaagatattaaaccaagtgatatcatgaccaaagaagcttttgaaaatgccataacaattgtcatggtccttggaggctcaaccaatgctgtgcttcatatcattgcaatggcaaatgccattggtgtagaaattacgcaagatgatttccaacgtatttcagatattatccctgttcttggcgatttcaaaccgagcggaaaatatatgatggaagatctgcacaaaattggtggccttcctgctgttttgaaatacctacttaaagaaggaaaacttcacggtgattgtttgaccgtcacaggtaaaactttggctgaaaatgttgaaacagcattagatttggactttgacagtcaagatattatgcgaccactaaaaaatccaattaaagctactggacatttacaaattttgtacggtaatcttgcccaagggggttctgttgcaaaaatttctggtaaagaaggcgaatttttcaaaggaacagctcgtgtttttgacggagaacaacactttatcgatggcattgagtctggccgattgcatgccggtgatgttgcggtcattagaaatattggcccagtcggaggtccgggaatgccagagatgttaaaaccaacctcagcattaattggagcaggacttggaaaatcttgtgccctaattactgacggaagattttctggtggcacacacggctttgttgtgggtcatatcgtccctgaagcagttgaaggtgggttgattggtttagttgaagatgatgatattatcgaaattgatgcggtgaataatagtattagtttaaaagtttctaatgaagaaattgctaaacgacgtgccaattatcaaaaaccaacccctaaagcaacgcgtggtgttcttgcaaaatttgccaaacttacgcgccccgctagtgaaggttgcgttacagatttatgttgtcctggttgctgtggttagttaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtactagttctagagcggccgccaccgcggtgg

SEQ ID NO: 961 - DNA, 22 bp, Artificial Sequence
  Primer oBP594
agctgtctcgtgttgtgggttt

SEQ ID NO: 962 - DNA, 49 bp, Artificial Sequence
  Primer oBP595
cttaataatagaacaatatcatcctttacgggcatcttatagtgtcgtt

SEQ ID NO: 963 - DNA, 49 bp, Artificial Sequence
  Primer oBP596
gcgccaacgacactataagatgcccgtaaaggatgatattgttctatta

SEQ ID NO: 964 - DNA, 49 bp, Artificial Sequence
  Primer oBP597
tatggaccctgaaaccacagccacattgcaacgacgacaatgccaaacc

SEQ ID NO: 965 - DNA, 49 bp, Artificial Sequence
  Primer oBP598
tccttggtttggcattgtcgtcgttgcaatgtggctgtggtttcagggt

SEQ ID NO: 966 - DNA, 49 bp, Artificial Sequence
  Primer oBP599
atcctctcgcggagtccctgttcagtaaaggccatgaagctttttcttt

SEQ ID NO: 967 - DNA, 49 bp, Artificial Sequence
  Primer oBP600
attggaaagaaaaagcttcatggcctttactgaacagggactccgcgag

SEQ ID NO: 968 - DNA, 22 bp, Artificial Sequence
  Primer oBP601
tcataccacaatcttagaccat

SEQ ID NO: 969 - DNA, 21 bp, Artificial Sequence
  Primer oBP602
tgttcaaacccctaaccaacc

SEQ ID NO: 970 - DNA, 22 bp, Artificial Sequence
  Primer oBP603
tgttcccacaatctattaccta

SEQ ID NO: 971 - DNA, 21 bp, Artificial Sequence
  Primer oBP605
tactgaacagggactccgcga

SEQ ID NO: 972 - DNA, 21 bp, Artificial Sequence
  Primer oBP606
tcataccacaatcttagacca

SEQ ID NO: 973 - DNA, 32 bp, Artificial Sequence
  Primer oBP622
aattggtaccccaaaaggaatattgggtcaga

SEQ ID NO: 974 - DNA, 49 bp, Artificial Sequence
  Primer oBP623
ccattgtttaaacggcgcgccggatcctttgcgaaaccctatgctctgt

SEQ ID NO: 975 - DNA, 49 bp, Artificial Sequence
  Primer oBP624
gcaaaggatccggcgcgccgtttaaacaatggaaggtcgggatgagcat

SEQ ID NO: 976 - DNA, 34 bp, Artificial Sequence
  Primer oBP625
aattggccggcctacgtaacattctgtcaaccaa

SEQ ID NO: 977 - DNA, 34 bp, Artificial Sequence
  Primer oBP626
aattgcggccgcttcatatatgacgtaataaaat

SEQ ID NO: 978 - DNA, 34 bp, Artificial Sequence
  Primer oBP627
aattttaattaattttttttcttggaatcagtac

SEQ ID NO: 979 - DNA, 34 bp, Artificial Sequence
  Primer oBP744
aattggcgcgccagagtacaacgatcaccgcctg

SEQ ID NO: 980 - DNA, 34 bp, Artificial Sequence
  Primer oBP745
aattgtttaaacgaacgaaagttacaaaatctag

SEQ ID NO: 981 - DNA, 22 bp, Artificial Sequence
  Primer oBP636
catttttttccctctaagaagc

SEQ ID NO: 982 - DNA, 22 bp, Artificial Sequence
  Primer oBP637
tttttgcacagttaaactaccc

SEQ ID NO: 983 - DNA, 26 bp, Artificial Sequence
  Primer HY840
ccaaaatcagccccacgacggccata

SEQ ID NO: 984 - DNA, 11856 bp, Artificial Sequence
  pYZ090
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcgctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 985 - DNA, 15539 bp, Artificial sequence
  pLH468
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 986 - DNA, 4586 bp, Artificial Sequence
  pLA54
gggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccgcattgcggattacgtattctaatgttcagataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatctataacttcgtatagcatacattatacgaagttatccagtgatgatacaacgagttagccaaggtg

SEQ ID NO: 987 - DNA, 80 bp, Artificial sequence
  Primer BK505
ttccggtttctttgaaatttttttgattcggtaatctccgagcagaaggagcattgcggattacgtattctaatgttcag

SEQ ID NO: 988 - DNA, 81 bp, Artificial sequence
  Primer BK506
gggtaataactgatataattaaattgaagctctaatttgtgagtttagtacaccttggctaactcgttgtatcatcactgg

SEQ ID NO: 989 - DNA, 38 bp, Artificial sequence
  Primer LA468
gcctcgagttttaatgttacttctcttgcagttaggga

SEQ ID NO: 990 - DNA, 31 bp, Artificial sequence
  Primer LA492
gctaaattcgagtgaaacacaggaagaccag

SEQ ID NO: 991 - DNA, 24 bp, Artificial sequence
  oBP452
ttctcgacgtgggcctttttcttg

SEQ ID NO: 992 - DNA, 49 bp, Artificial sequence
  oBP453
tgcagctttaaataatcggtgtcactactttgccttcgtttatcttgcc

SEQ ID NO: 993 - DNA, 49 bp, Artificial sequence
  Primer oBP454
gagcaggcaagataaacgaaggcaaagtagtgacaccgattatttaaag

SEQ ID NO: 994 - DNA, 49 bp, Artificial sequence
  Primer oBP455
tatggaccctgaaaccacagccacattgtaaccaccacgacggttgttg

SEQ ID NO: 995 - DNA, 49 bp, Artificial sequence
  Primer oBP456
tttagcaacaaccgtcgtggtggttacaatgtggctgtggtttcagggt

SEQ ID NO: 996 - DNA, 49 bp, Artificial sequence
  Primer oBP457
ccagaaaccctatacctgtgtggacgtaaggccatgaagctttttcttt

SEQ ID NO: 997 - DNA, 49 bp, Artificial sequence
  Primer oBP458
attggaaagaaaaagcttcatggccttacgtccacacaggtatagggtt

SEQ ID NO: 998 - DNA, 22 bp, Artificial sequence
  Primer oBP459
cataagaacacctttggtggag

SEQ ID NO: 999 - DNA, 22 bp, Artificial sequence
  Primer oBP460
aggattatcattcataagtttc

SEQ ID NO: 1000 - DNA, 23 bp, Artificial sequence
  Primer oBP461
ttcttggagctgggacatgtttg

SEQ ID NO: 1001 - DNA, 22 bp, Artificial sequence
  Primer oBP450
tgatgatatttcataaataatg

SEQ ID NO: 1002 - DNA, 23 bp, Artificial sequence
  Primer oBP451
atgcgtccatctttacagtcctg

SEQ ID NO: 1003 - DNA, 22 bp, Artificial sequence
  Primer oBP440
tacgtacggaccaatcgaagtg

SEQ ID NO: 1004 - DNA, 49 bp, Artificial sequence
  Primer oBP441
aattcgtttgagtacactactaatggctttgttggcaatatgtttttgc

SEQ ID NO: 1005 - DNA, 49 bp, Artificial sequence
  Primer oBP442
atatagcaaaaacatattgccaacaaagccattagtagtgtactcaaac

SEQ ID NO: 1006 - DNA, 49 bp, Artificial sequence
  Primer oBP443
tatggaccctgaaaccacagccacattcttgttatttataaaaagacac

SEQ ID NO: 1007 - DNA, 49 bp, Artificial sequence
  Primer oBP444
ctcccgtgtctttttataaataacaagaatgtggctgtggtttcagggt

SEQ ID NO: 1008 - DNA, 49 bp, Artificial sequence
  Primer oBP445
taccgtaggcgtccttaggaaagatagaaggccatgaagctttttcttt

SEQ ID NO: 1009 - DNA, 49 bp, Artificial sequence
  Primer oBP446
attggaaagaaaaagcttcatggccttctatctttcctaaggacgccta

SEQ ID NO: 1010 - DNA, 21 bp, Artificial sequence
  Primer oBP447
ttattgtttggcatttgtagc

SEQ ID NO: 1011 - DNA, 7523 bp, Artificial sequence
  pRS423::PGAL-cre
ccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtccgccaccgcggtggagct

SEQ ID NO: 1012 - DNA, 22 bp, Artificial sequence
  Primer oBP448
ccaagcatctcataaacctatg

SEQ ID NO: 1013 - DNA, 22 bp, Artificial sequence
  Primer oBP449
tgtgcagatgcagatgtgagac

SEQ ID NO: 1014 - DNA, 17 bp, Artificial sequence
  Primer oBP554
agttattgataccgtac

SEQ ID NO: 1015 - DNA, 19 bp, Artificial sequence
  Primer oBP555
cgagataccgtaggcgtcc

SEQ ID NO: 1016 - DNA, 24 bp, Artificial sequence
  Primer oBP513
ttatgtatgctcttctgacttttc

SEQ ID NO: 1017 - DNA, 49 bp, Artificial sequence
  Primer oBP515
aataattagagattaaatcgctcattttttgccagtttcttcaggcttc

SEQ ID NO: 1018 - DNA, 49 bp, Artificial sequence
  Primer oBP516
agcctgaagaaactggcaaaaaatgagcgatttaatctctaattattag

SEQ ID NO: 1019 - DNA, 49 bp, Artificial sequence
  Primer oBP517
tatggaccctgaaaccacagccacatttttcaatcattggagcaatcat

SEQ ID NO: 1020 - DNA, 49 bp, Artificial sequence
  Primer oBP518
taaaatgattgctccaatgattgaaaaatgtggctgtggtttcagggtc

SEQ ID NO: 1021 - DNA, 49 bp, Artificial sequence
  Primer oBP519
accgtaggtgttgtttgggaaagtggaaggccatgaagctttttctttc

SEQ ID NO: 1022 - DNA, 49 bp, Artificial sequence
  Primer oBP520
ttggaaagaaaaagcttcatggccttccactttcccaaacaacacctac

SEQ ID NO: 1023 - DNA, 23 bp, Artificial sequence
  Primer oBP521
ttattgcttagcgttggtagcag

SEQ ID NO: 1024 - DNA, 21 bp, Artificial sequence
  Primer oBP511
tttttggtggttccggcttcc

SEQ ID NO: 1025 - DNA, 22 bp, Artificial sequence
  Primer oBP512
aaagttggcatagcggaaactt

SEQ ID NO: 1026 - DNA, 16 bp, Artificial sequence
  Primer oBP550
gtcattgacaccatct

SEQ ID NO: 1027 - DNA, 19 bp, Artificial sequence
  Primer oBP551
agagataccgtaggtgttg

SEQ ID NO: 1028 - DNA, 11844 bp, Artificial sequence
  pYZ090
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcgctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggcctatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 1029 - DNA, 90 bp, Artificial sequence
  Primer LA512
gtattttggtagattcaattctctttccctttccttttccttcgctccccttccttatcagcattgcggattacgtattctaatgttcag

SEQ ID NO: 1030 - DNA, 90 bp, Artificial sequence
  Primer LA513
ttggttgggggaaaaagaggcaacaggaaagatcagagggggagggggggggagagtgtcaccttggctaactcgttgtatcatcactgg

SEQ ID NO: 1031 - DNA, 21 bp, Artificial sequence
  Primer oBP264
tcggtgcgggcctcttcgcta

SEQ ID NO: 1032 - DNA, 21 bp, Artificial sequence
  Primer oBP265
aatgtgagttagctcactcat

SEQ ID NO: 1033 - DNA, 57 bp, Artificial sequence
  Primer oBP438
aattggatccggcgcgccgtttaaacggccggccaatgtggctgtggtttcagggtc

SEQ ID NO: 1034 - DNA, 49 bp, Artificial sequence
  Primer oBP439
aatttctagattaattaagcggccgcaaggccatgaagctttttctttc

SEQ ID NO: 1035 - DNA, 33 bp, Artificial sequence
  Primer oBP530
aattggcgcgccatgaaagctctggtttatcac

SEQ ID NO: 1036 - DNA, 49 bp, Artificial sequence
  Primer oBP531
tgaatcatgagttttatgttaattagctcaggcagcgcctgcgttcgag

SEQ ID NO: 1037 - DNA, 49 bp, Artificial sequence
  Primer oBP532
atcctctcgaacgcaggcgctgcctgagctaattaacataaaactcatg

SEQ ID NO: 1038 - DNA, 34 bp, Artificial sequence
  Primer oBP533
aattgtttaaacaagtaaataaattaatcagcat

SEQ ID NO: 1039 - DNA, 49 bp, Artificial sequence
  Primer oBP536
acacaatacaataacaagaagaacaaaatgaaagctctggtttatcacg

SEQ ID NO: 1040 - DNA, 49 bp, Artificial sequence
  Primer oBP546
agcgtatacatctgttgggaaagtagaaggccatgaagctttttctttc

SEQ ID NO: 1041 - DNA, 49 bp, Artificial sequence
  Primer oBP547
ttggaaagaaaaagcttcatggccttctactttcccaacagatgtatac

SEQ ID NO: 1042 - DNA, 22 bp, Artificial sequence
  Primer oBP539
ttattgtttagcgttagtagcg

SEQ ID NO: 1043 - DNA, 72 bp, Artificial sequence
  Primer oBP542
cataatcaatctcaaagagaacaacacaatacaataacaagaagaacaaaatgaaagctctggtttatcacg

SEQ ID NO: 1044 - DNA, 21 bp, Artificial sequence
  Primer oBP540
taggcataatcaccgaagaag

SEQ ID NO: 1045 - DNA, 21 bp, Artificial sequence
  Primer oBP541
aaaatggtaagcagctgaaag

SEQ ID NO: 1046 - DNA, 17 bp, Artificial sequence
  Primer oBP552
agttgttagaactgttg

SEQ ID NO: 1047 - DNA, 19 bp, Artificial sequence
  Primer oBP553
gacgatagcgtatacatct

SEQ ID NO: 1048 - DNA, 22 bp, Artificial sequence
  Primer oBP582
cttagcctctagccatagccat

SEQ ID NO: 1049 - DNA, 23 bp, Artificial sequence
  Primer AA270
ttagttttgctggccgcatcttc

SEQ ID NO: 1050 - DNA, 21 bp, Artificial sequence
  Primer oBP591
cccattaatatactattgaga

SEQ ID NO: 1051 - DNA, 15456 bp, Artificial sequence
  pLH468-sadB
aaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaggcagcgcctgcgttcgagaggatgatcttcatcgccttctccttggcgccattgaggaatacctgataggcgtgctcgatctcggccagctcgaagcgatgggtaatcatcttcttcaacggaagcttgtcggtcgaggcgaccttcatcagcatgggcgtcgtgttcgtgttcaccagtcccgtggtgatcgtcaggttcttgatccagagcttctgaatctcgaagtcaaccttgacgccatgcacgccgacgttggcgatgtgcgcgccgggcttgacgatctcctggcagatgtcccaagtcgccggtatgcccaccgcctcgatcgcaacatcgactccctctgccgcaatcctatgcacggcttcgacaacgttctccgtgccggagttgatggtgtgcgttgccccgagctccttggcgagctggaggcgattctcgtccatgtcgatcacgatgatggtcgagggggagtagaactgggcggtcaacagtacggacatgccgacggggcccgcgccgacaatagccaccgcatcgcccggctggacattcccatactggacgccgatttcgtggccggtgggcaggatgtcgctcagcaggacggcgatttcgtcgtcaattgtctgggggatcttgtagaggctgttgtcggcatgcgggatgcggacgtattcggcctgcacgccatcgatcatgtaacccaggatccacccgccgtcgcggcaatgggagtaaagctgcttcttgcagtagtcgcacgagccgcaagaagtgacgcaggaaatcaggaccttgtcgcctttcttgaactgcgtgacactctcgcccacttcctcgatgacgcctaccccttcatggcccaggatgcgcccgtcggcgacctctggattcttgcctttgtagatgccgagatccgtgccgcagatcgtggtcttcaaaacccgtactactacatccgtgggcttttgaagggtgggcttgggcttgtcttcaagcgagatcttgtggtcaccgtgataaaccagagctttcatcctcagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtct

SEQ ID NO: 1052 - DNA, 1559 bp, Artificial sequence
  loxP-URA3-loxP
gcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtg

SEQ ID NO: 1053 - DNA, 2237 bp, Artificial sequence
  PDC1 Fragment A-ilvDSm
ttatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaaatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgagcgatttaatctctaattatt

SEQ ID NO: 1054 - DNA, 4420 bp, Artificial sequence
  PDC1 A-ilvDSm-BUC cassette
ttatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaaatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgagcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaacactgtttaaacagtgtggtttccaaaaccctgaaactgcattagtgtaatagaagactagacacctcgatacaaataatggttactcaattcaaaactgccagcgaattcgactctgcaattgctcaagacaagctagttgtcgtagatttctacgccacttggtgcggtccatgtaaaatgattgctccaatgattgaaaaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaataa

SEQ ID NO: 1055 - DNA, 3521 bp, Artificial sequence
  PDC5 A-sadB-BUC cassette
aaggaaataaagcaaataacaataacaccattattttaattttttttctattactgtcgctaacacctgtatggttgcaaccaggtgagaatccttctgatgcatactttatgcgtttatgcgttttgcgccccttggaaaaaaattgattctcatcgtaaatgcatactacatgcgtttatgggaaaagcctccatatccaaaggtcgcgtttcttttagaaaaactaatacgtaaacctgcattaaggtaagattatatcagaaaatgtgttgcaagaaatgcattatgcaattttttgattatgacaatctctcgaaagaaatttcatatgatgagacttgaataatgcagcggcgcttgctaaaagaacttgtatataagagctgccattctcgatcaatatactgtagtaagtcctttcctctctttcttattacacttatttcacataatcaatctcaaagagaacaacacaatacaataacaagaagaacaaaatgaaagctctggtttatcacggtgaccacaagatctcgcttgaagacaagcccaagcccacccttcaaaagcccacggatgtagtagtacgggttttgaagaccacgatctgcggcacggatctcggcatctacaaaggcaagaatccagaggtcgccgacgggcgcatcctgggccatgaaggggtaggcgtcatcgaggaagtgggcgagagtgtcacgcagttcaagaaaggcgacaaggtcctgatttcctgcgtcacttcttgcggctcgtgcgactactgcaagaagcagctttactcccattgccgcgacggcgggtggatcctgggttacatgatcgatggcgtgcaggccgaatacgtccgcatcccgcatgccgacaacagcctctacaagatcccccagacaattgacgacgaaatcgccgtcctgctgagcgacatcctgcccaccggccacgaaatcggcgtccagtatgggaatgtccagccgggcgatgcggtggctattgtcggcgcgggccccgtcggcatgtccgtactgttgaccgcccagttctactccccctcgaccatcatcgtgatcgacatggacgagaatcgcctccagctcgccaaggagctcggggcaacgcacaccatcaactccggcacggagaacgttgtcgaagccgtgcataggattgcggcagagggagtcgatgttgcgatcgaggcggtgggcataccggcgacttgggacatctgccaggagatcgtcaagcccggcgcgcacatcgccaacgtcggcgtgcatggcgtcaaggttgacttcgagattcagaagctctggatcaagaacctgacgatcaccacgggactggtgaacacgaacacgacgcccatgctgatgaaggtcgcctcgaccgacaagcttccgttgaagaagatgattacccatcgcttcgagctggccgagatcgagcacgcctatcaggtattcctcaatggcgccaaggagaaggcgatgaagatcatcctctcgaacgcaggcgctgcctgagctaattaacataaaactcatgattcaacgtttgtgtatttttttacttttgaaggttatagatgtttaggtaaataattggcatagatatagttttagtataataaatttctgatttggtttaaaatatcaactattttttttcacatatgttcttgtaattacttttctgtcctgtcttccaggttaaagattagcttctaatattttaggtggtttattatttaattttatgctgattaatttatttacttgtttaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttctactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaataa

SEQ ID NO: 1056 - DNA, 2686 bp, Artificial sequence
  pUC19
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 1057 - DNA, 1685 bp, Artificial sequence
  gpd2::loxP-URA3-loxP cassette
gtattttggtagattcaattctctttccctttccttttccttcgctccccttccttatcagcattgcggattacgtattctaatgttcagataacttcgtatagcatacattatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtatagcatacattatacgaagttatccagtgatgatacaacgagttagccaaggtgacactctccccccccctccccctctgatctttcctgttgcctctttttcccccaaccaa

What is claimed is:

1. A recombinant yeast host cell comprising:
   (a) at least one heterologous polynucleotide encoding a dihydroxy-acid dehydratase enzyme (DHAD), wherein the dihydroxy-acid dehydratase enzyme has an amino acid sequence with at least 95% identity to SEQ ID NO: 168; and
   (b) at least one deletion in an endogenous gene encoding a polypeptide affecting Fe—S cluster biosynthesis, wherein the gene encoding the polypeptide affecting Fe—S cluster biosynthesis is FRA2.

2. The recombinant yeast host cell of claim 1, wherein said at least one heterologous polynucleotide encoding a dihydroxy-acid dehydratase enzyme is integrated at least once in the recombinant yeast host cell DNA.

3. The recombinant yeast host cell of claim 1, wherein the dihydroxy-acid dehydratase enzyme is expressed in the cytosol of the recombinant yeast host cell.

4. The recombinant yeast host cell of claim 1, wherein the dihydroxy-acid dehydratase enzyme has the amino acid sequence of SEQ ID NO: 168.

5. The recombinant yeast host cell of claim 1, wherein said recombinant yeast host cell produces isobutanol.

6. The recombinant yeast host cell of claim 1, wherein said recombinant yeast host cell comprises an isobutanol biosynthetic pathway.

7. The recombinant yeast host cell of claim 1, wherein monomers of the dihydroxy-acid dehydratase enzyme have an Fe—S cluster loading selected from the group consisting of:
   (a) at least 10%;
   (b) at least 15%;
   (c) at least 20%;
   (d) at least 25%;
   (e) at least 30%;
   (f) at least 35%;
   (g) at least 40%;
   (h) at least 45%;
   (i) at least 50%;
   (j) at least 60%;
   (k) at least 70%;
   (l) at least 80%;
   (m) at least 90%; and
   (n) at least 95%.

8. A method of making a product comprising:
(a) providing the recombinant yeast host cell of claim 1;
(b) contacting the recombinant yeast host cell of (a) with a fermentable carbon substrate in a fermentation medium under conditions wherein said product is produced;
wherein the product is selected from the group consisting of branched chain amino acids, pantothenic acid, 2-methyl-1-butanol, 3-methyl-l-butanol, isobutanol, and combinations thereof.

9. A method of making isobutanol comprising:
(a) providing the recombinant yeast host cell of claim 1;
(b) contacting the recombinant yeast host cell of (a) with a fermentable carbon substrate in a fermentation medium under conditions wherein isobutanol is produced.

10. A method for the conversion of 2,3-dihydroxyisovalerate to a-ketoisovalerate comprising:
(a) providing the recombinant yeast host of claim 1; and
(b) growing the recombinant yeast host cell of (a) under conditions where the 2,3-dihydroxyisovalerate is converted to a-ketoisovalerate,
wherein 2,3-dihydroxyisovalerate is converted to a-ketoisovalerate.

11. The method of claim 10, wherein said conversion of 2,3-dihydroxyisovalerate to a-ketoisovalerate compared to a control yeast host cell containing at least one heterologous polynucleotide encoding dihydroxy-acid dehydratase is increased in an amount selected from the group consisting of:
(a) at least 5%;
(b) at least 10%;
(c) at least 15%;
(d) at least 20%;
(e) at least 25%;
(f) at least 30%;
(g) at least 35%;
(h) at least 40%;
(i) at least 45%;
(j) at least 50%;
(k) at least 60%;
(l) at least 70%;
(m) at least 80%;
(n) at least 90%; and
(o) at least 95%.

12. A method of increasing the catalytic activity of DHAD in a recombinant yeast host cell comprising:
(a) providing the recombinant yeast host cell of claim 1; and
(b) growing the recombinant yeast host cell of (a) under conditions whereby the catalytic activity of the DHAD is increased.

13. The method of claim 12, wherein said increased catalytic activity is selected from the group consisting of:
(a) greater than 10%;
(b) greater than 20%;
(c) greater than 30%;
(d) greater than 40%;
(e) greater than 50%;
(f) greater than 60%;
(g) greater than 70%;
(h) greater than 80%;
(i) greater than 90%; and
(j) greater than 95%.

* * * * *